US012624091B2

(12) United States Patent (10) Patent No.: US 12,624,091 B2
Pilewski et al. (45) Date of Patent: May 12, 2026

(54) HIV/HCV CROSS-REACTIVE ANTIBODIES AND USES THEREOF

(71) Applicant: VANDERBILT UNIVERSITY, Nashville, TN (US)

(72) Inventors: Kelsey Pilewski, Nashville, TN (US); Ivelin Stefanov Georgiev, Brentwood, TN (US)

(73) Assignee: VANDERBILT UNIVERSITY, Nashville, TN (US)

( * ) Notice: Subject to any disclaimer, the term of this patent is extended or adjusted under 35 U.S.C. 154(b) by 1102 days.

(21) Appl. No.: 17/600,893

(22) PCT Filed: Apr. 3, 2020

(86) PCT No.: PCT/US2020/026552
§ 371 (c)(1),
(2) Date: Oct. 1, 2021

(87) PCT Pub. No.: WO2020/206232
PCT Pub. Date: Oct. 8, 2020

(65) Prior Publication Data
US 2022/0185870 A1 Jun. 16, 2022

Related U.S. Application Data

(60) Provisional application No. 62/971,477, filed on Feb. 7, 2020, provisional application No. 62/829,526, filed on Apr. 4, 2019.

(51) Int. Cl.
C07K 16/10 (2006.01)

(52) U.S. Cl.
CPC ........ C07K 16/1045 (2013.01); C07K 16/109 (2013.01); *C07K 2317/33* (2013.01)

(58) Field of Classification Search
CPC .............. C07K 16/1045; C07K 16/109; C07K 2317/33
See application file for complete search history.

(56) References Cited

U.S. PATENT DOCUMENTS

| | | | |
|---|---|---|---|
| 4,342,566 A | 8/1982 | Dixon et al. | |
| 5,804,440 A | 9/1998 | Barbas et al. | |
| 6,096,441 A | 8/2000 | Hauser et al. | |
| 2004/0110933 A1 | 6/2004 | Rondon et al. | |
| 2015/0191739 A1 | 7/2015 | La Rosa et al. | |
| 2017/0088620 A1* | 3/2017 | Nioi | C07K 16/2851 |
| 2017/0355756 A1* | 12/2017 | Julien | C07K 16/18 |
| 2018/0282400 A1 | 10/2018 | Mouquet et al. | |

FOREIGN PATENT DOCUMENTS

| | | | |
|---|---|---|---|
| WO | 94/04678 | 3/1994 | |
| WO | 94/29348 | 12/1994 | |
| WO | 2001032893 A1 | 5/2001 | |
| WO | WO-2008068048 A2 * | 6/2008 | .............. A61P 31/10 |
| WO | 2014065822 A1 | 5/2014 | |
| WO | 2018125813 A1 | 7/2018 | |
| WO | 2019/143884 | 7/2019 | |
| WO | 2020033164 | 2/2020 | |

OTHER PUBLICATIONS

Hwang, Kwan-Ki, et al. "IGHV 1-69 B Cell Chronic Lymphocytic Leukemia Antibodies Cross-React with HIV-1 and Hepatitis C Virus Antigens as Well as Intestinal Commensal Bacteria." PloS one 9(3) (2014): e90725. (Year: 2014).*
Chiu, Mark L., et al. "Antibody structure and function: the basis for engineering therapeutics." Antibodies 8(4) (2019): 55. (Year: 2019).*
Rudikoff, Stuart, et al. "Single amino acid substitution altering antigen-binding specificity." Proceedings of the National Academy of Sciences 79(6) (1982): 1979-1983. (Year: 1982).*
Sela-Culang, Inbal, Vered Kunik, and Yanay Ofran. "The structural basis of antibody-antigen recognition." Frontiers in immunology 4 (2013): 302. (Year: 2013).*
International Search Report and Written Opinion dated Aug. 18, 2020, from International Application No. PCT/US2020/026552, 11 pages.
Bailey, Jr et al. "Broadly neutralizing antibodies with few somatic mutations and hepatitis C virus clearance", JCI Insight, 2017;2(9), 17 pages.
Georgiev, Is et al. "Delineating Antibody Recognition in Polyclonal Sera from Patterns of HIV-1 Isolate Neutralization", Science, vol. 340, May 10, 2013, pp. 751-756.
Kohler and Milstein, Nature, 256:495 (1975).
Needleman et al. (1970) J. Mol. Biol. 48: 443-453.
Zoller, M.J. Curr. Opin. Biotechnol. 3:348-354, (1992).
Zabat E.A. et al., (1991) Sequences of proteins of immunological interest. NIH Publication 91-3242.
Al-Lazikani et al., 1997. J. Mol. Biol., 273:927-948.
MacCallum et al., 1996, J. Mol. Biol, 262:732-745.
Lefranc et al., Dev. Comp. Immunol., 2003, 27:55-77.
Honegger and Plückthun, J. Mol. Biol., 2001, 309:657-70.
International Preliminary Report on Patentability issued for Application No. PCT/US2020/026552, dated dated Oct. 14, 2021.
Anonymous. Third Party Observation in connection with International Application No. PCT/US2020/026552. Submitted Aug. 4, 2021.
Burgess Stg et al. A multiplexed protein microarray for the simultaneous serodiagnosis of human immunodeficiency virus/hepatitis C virus infection and typing of whole blood. Analytical Biochemistry. 382(1): 9-15(Nov. 1, 2008).
Chen F et al. VH1-69 antiviral broadly neutralizing antibodies: genetics, structures, and relevance to rational vaccine design. Current opinion in Virology. 34:149-159(Mar. 16, 2019).

(Continued)

*Primary Examiner* — Julie Wu
*Assistant Examiner* — Bryan William Heck
(74) *Attorney, Agent, or Firm* — Meunier Carlin & Curfman LLC

(57) ABSTRACT

The present disclosure relates to antibodies and uses thereof for treating an HIV infection, an HCV infection, or an HIV/HCV co-infection.

19 Claims, 81 Drawing Sheets
(71 of 81 Drawing Sheet(s) Filed in Color)
Specification includes a Sequence Listing.

(56)                   References Cited

OTHER PUBLICATIONS

Leem J. Thesis on: Development of computational methodologies for antibody design. St Anne's College University of Oxford (2016).

Partial Supplementary European Search Report Communication pursuant to Rule 164(1) EPC, issued in connection with European Patent Application No. 20785367.2. May 12, 2023.

Pilewski K et al. Antibody cross-reactivity in chronic HIV/HCV co-infection. The Journal of Immunology. 2021 (1_Suppl):72.7-72. 7, XP093042811(May 1, 2019).

Warter L et al. Human poly- and cross-reactive anti-viral antibodies and their impact on protection and pathology. Immunologic Research. 53(1): 148-161(Mar. 21, 2012).

* cited by examiner

| Antigen name | Virus | Strain/Clade | Native function |
|---|---|---|---|
| BG505.SOSIP | HIV | A | Cell entry |
| B41.SOSIP | HIV | B | Cell entry |
| ConC gp120 | HIV | C | Cell entry |
| AE.A244 gp120 | HIV | AE | Cell entry |
| JFH-1 E2core | HCV | JFH1 (genotype 2a) | Cell entry |
| H77 E2core | HCV | H77 (genotype 1a) | Cell entry |
| H77 E1E2 | HCV | H77 (genotype 1a) | Cell entry |

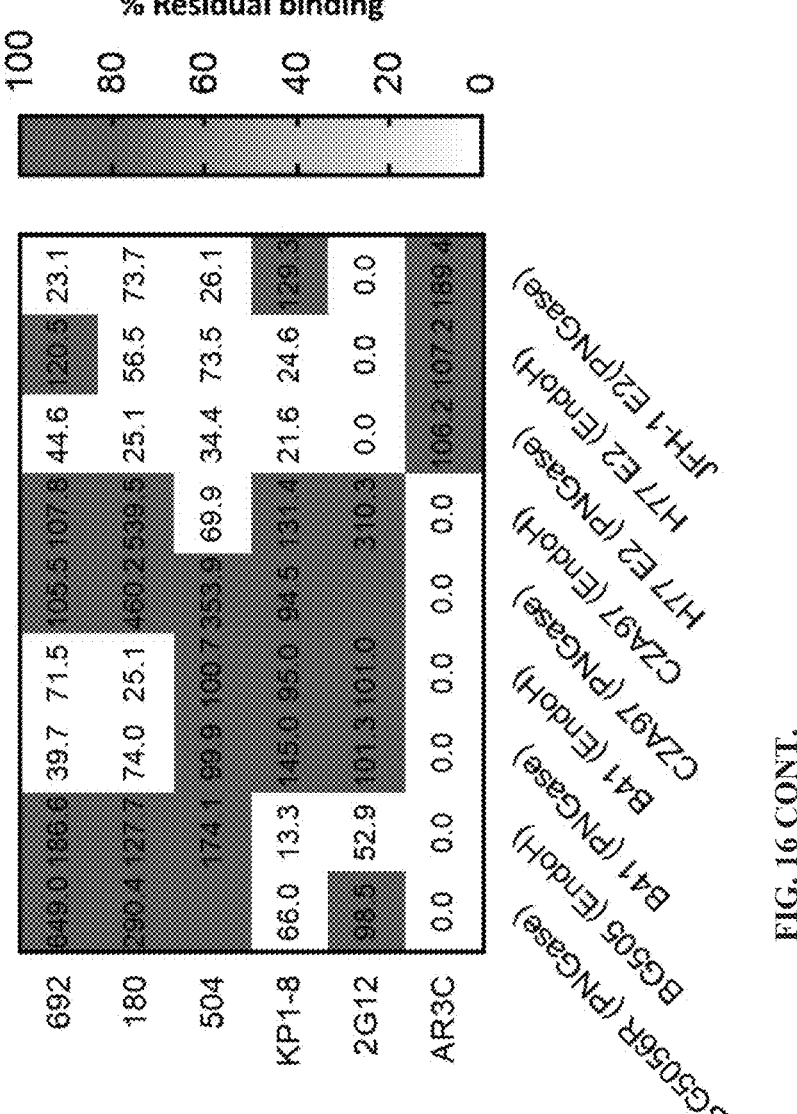
FIG. 16 CONT.
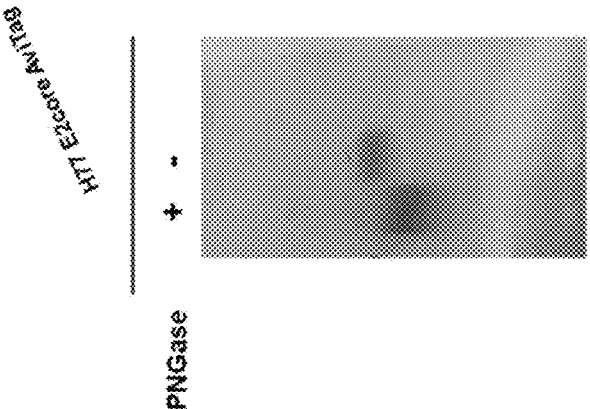

BG505 gp140 (SOSIP)

PDB: 4ZMJ

H77 E2core

PDB: 4MWF.D

Polyreactivity mAb

Joe Balsomo, Bachmann group

| PID | Sex | Yr of Infection | Infection Status | Secondary Infection | HIV Medication |
|-----|-----|-----------------|------------------|---------------------|----------------|
| ci10014 | M | 2003 | Chronic | HepC | NA |

HCV infection?

Blood draw 09/25/2003

Blood draw 11/03/2005

HIV infection 2003

Blood draw 10/14/2004

Blood draw 03/21/2006

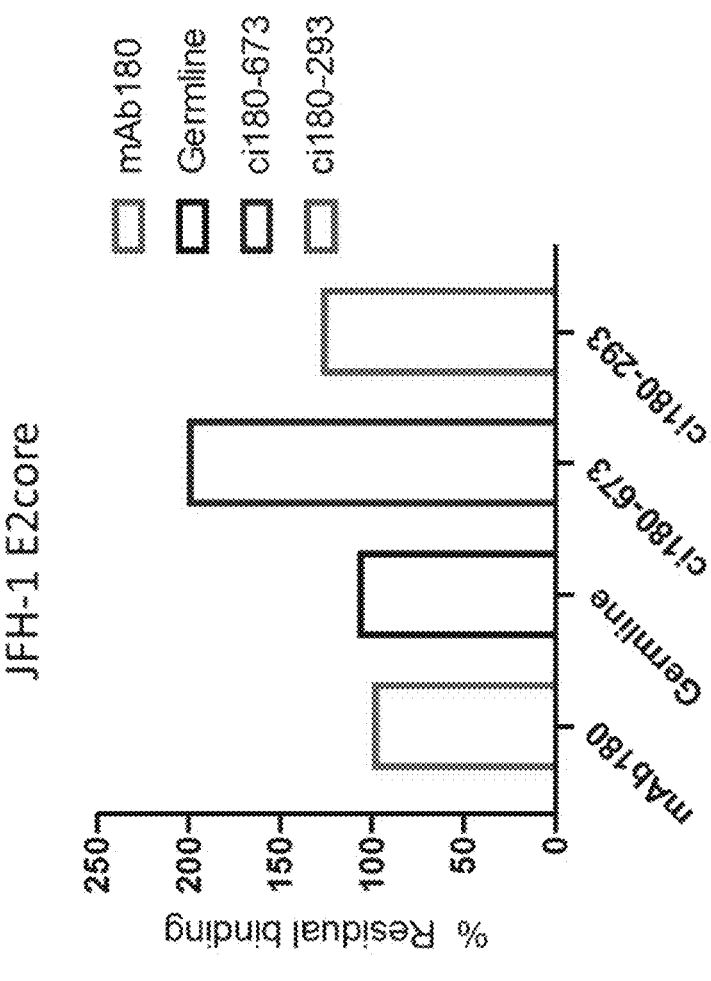
FIG. 31B
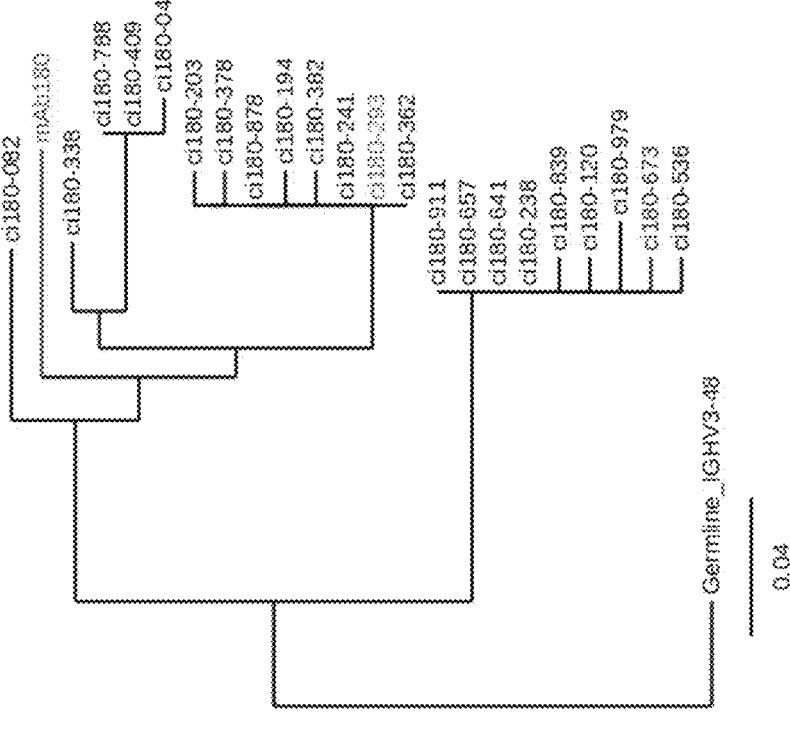

- HCV co-infection with HIV leads to:
  - HCV and HIV viral load (VL)
  - Progression to fibrosis and liver failure
  - Cardiovascular disease and stroke risk
  - HAART and DAA-associated adverse effects
  - Infection-related mortality HIV Env subtype diversity HCV E1E2 genotypic diversity Distance
—— 0.05

- BCR vs. Antibody
  - Antibodies= secreted BCR

- Clonotype
  - B cells with related sequences that are assumed to have originated from the same progenitor

- Gene/junctional diversity vs. affinity maturation

Infection Time

>24 HIV/HCV co-infected donors, accounting for >100 samples

| Patient ID | # time points |
|---|---|
| 10014 | 13 |
| 10015 | 9 |
| 10027 | 10 |

| Year post HIV infection (ypi) | 0.5 ypi | ~1.5 ypi | 3 ypi |
|---|---|---|---|
| PBMC draw date | 9/25/2003 | 10/14/2004 | 03/22/2006 |

3. Use fluorescence-activated cell sorting to separate single, and double antigen-positive memory B cells.

| Antibody | IGHV | IGHJ | CDRH3 |
|---|---|---|---|
| A2 | V4-59 | J4-2 | CAREQRDYXSGFDYW |
| A12 | V4-39 | J4-2 | CARLRRDGSYHHGAPFYFDNW |
| B4 | V4-34 | J4-2 | CARGGYQDSAGYADYW |
| B6 | V3-48 | J4-2 | CARGGRDLVRGLVMTDFFDEW |
| B12 | V4-39 | J4-2 | CARLRWSSSWYYRFDYW |
| C4 | V3-15 | J2-1 | CTTAFSMKYCSSTNCPRSDWYFDLW |

HIV/HCV Cross-Reactive Antibody V$_H$ Mutations

Highest binding to both BG505 and E2 Avi

FIG. 54

SDS PAGE:
BG505Avi

Primary: 3BNC117

Secondary: anti-
human IgG HRP

SDS PAGE:
BG505Avi

Primary: B12

Secondary: anti-
human IgG HRP

SDS PAGE: E2Avi

Primary: AP33

Secondary: anti-
human IgG HRP

SDS PAGE: E2Avi

Primary: B12

Secondary: anti-
human IgG HRP

| Subtype | TIER | Pseudoviruses | B12(Run1) | B12 (Run2) |
|---------|------|---------------|-----------|------------|
| C | | MW965 | 27.4 | 39 |
| B | 1A | MN.3 | 22 | 24.2 |
| C | | 6644 | 15.2 | 41.2 |
| C | | DU156 | 25.4 | 25.8 |
| C | | CT349 | 26.4 | 18.6 |
| C | 1B | CAP37 | >50 | 17.6 |
| C | | CE1176 | >50 | >50 |
| A | 2 | BG505 | 33.8 | >50 |
| | | 6322 | >50 | |
| | | 620345 | >50 | |
| | | 6471 | >50 | |
| | | 97ZA | >50 | |
| | | X2088 | >50 | |
| | 4 | CAP210 | >50 | |
| | Control | MuLV | 22 | 16 |

FIG. 60

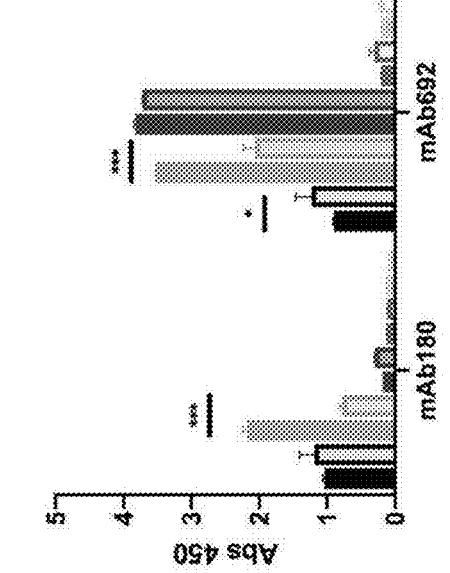
FIG. 69
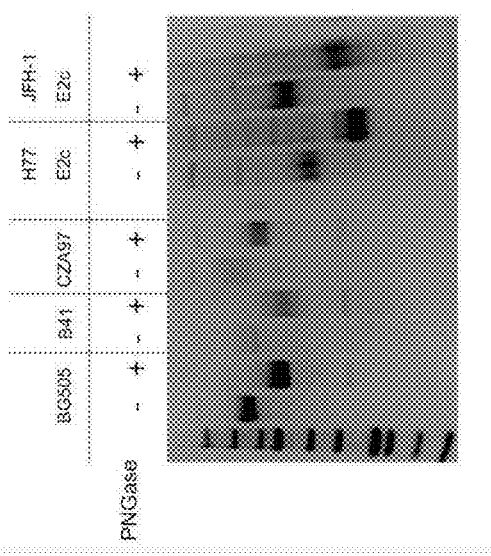

| | LPS | | Insulin | | WCL | |
| --- | --- | --- | --- | --- | --- | --- |
| | 1 | 2 | 3 | 4 | 5 | 6 |
| A — mAb180HC+722104-180LC | 0.05 | 0.05 | 0.051 | 0.048 | 0.045 | 0.047 |
| B — mAb180HC+71759-180LC | 0.041 | 0.043 | 0.054 | 0.043 | 0.043 | 0.044 |
| C — mAb180HC+671946-180LC | 0.04 | 0.042 | 0.053 | 0.048 | 0.042 | 0.041 |
| D — 359673-180HC+mAb180LC | 0.048 | 0.041 | 0.047 | 0.043 | 0.045 | 0.056 |
| E — 452878-180HC+mAb180LC | 0.043 | 0.044 | 0.042 | 0.046 | 0.043 | 0.043 |
| F — VRC01 | 0.051 | 0.046 | 0.05 | 0.057 | 0.22 | 0.075 |
| G — AP33 | 0.089 | 0.051 | 0.054 | 0.053 | 0.069 | 0.074 |
| H — Blank | 0.044 | 0.044 | 0.045 | 0.042 | 0.05 | 0.045 |

FIG. 70

| 1A | | BG505 sc Avi (WT) | BG505 sc Avi (WT) | CZA97 sc Avi (WT) | CZA97 sc Avi (WT) |
|---|---|---|---|---|---|
| 2A | mAb692 | 2.434 | 2.451 | 3.466 | 3.261 |
| Germline except CDR3 3A | germline 692 | 0.929 | 0.877 | 2.755 | 2.538 |
| 4A | g692HC+692LC | 1.257 | 1.185 | 3.073 | 2.608 |
| 5A | 692HC+g692LC | 2.103 | 2.156 | 3.357 | 3.439 |
| Earliest lineage member 6A | 58666-692LC+ 692 HC | 0.186 | 0.184 | 1.995 | 1.765 |
| 7A | AP33 | 0.073 | 0.056 | 0.046 | 0.055 |
| 8A | PG9 | 0.404 | 0.361 | 0.058 | 0.057 |
| 9A | Blank | 0.065 | 0.051 | 0.06 | 0.049 |

FIG. 71

| | H7E3 | H7E3 | [PH-1 G2] | [PH-1 G2] | E1E2 | E1E2 | LPS | LPS | Insulin | Insulin | WCL | WCL |
|---|---|---|---|---|---|---|---|---|---|---|---|---|
| mAb692 | 0.317 | 0.316 | 0.172 | 0.18 | 0.179 | 0.158 | 0.098 | 0.084 | 0.096 | 0.098 | 0.084 | 0.084 |
| germline-G92 | 0.134 | 0.141 | 0.113 | 0.112 | 0.097 | 0.096 | 0.068 | 0.062 | 0.072 | 0.066 | 0.086 | 0.078 |
| g692HC-692LC | 1.094 | 1.118 | 0.805 | 0.812 | 0.622 | 0.588 | 0.099 | 0.128 | 0.126 | 0.143 | 0.732 | 0.749 |
| 692HC-gG92LC | 0.174 | 0.171 | 0.142 | 0.113 | 0.074 | 0.125 | 0.065 | 0.066 | 0.14 | 0.154 | 0.052 | 0.054 |
| g692HC-g211-692HC | 0.506 | 0.482 | 0.335 | 0.322 | 0.282 | 0.256 | 0.147 | 0.147 | 0.094 | 0.122 | 0.131 | 0.138 |
| dE10 | | | | | | | 0.08 | 0.154 | 0.347 | 0.252 | 0.657 | 0.826 |
| PG16 (AP33 WCL) | 0.147 | 0.142 | 0.152 | 0.141 | 0.121 | 0.137 | 0.061 | 0.061 | 0.065 | 0.057 | 0.184 | 0.201 |
| AP33 (blank WCL) | 4.483 | 4.463 | 4.351 | 4.379 | 4.337 | 4.341 | 0.058 | 0.053 | 0.064 | 0.058 | 0.04 | 0.038 |

HIV/HCV CROSS-REACTIVE ANTIBODIES AND USES THEREOF

CROSS REFERENCE TO RELATED APPLICATIONS

This application is a United States National Phase Patent Application of International Patent Application Number PCT/US2020/026552, filed on Apr. 3, 2020, which claims the benefit of U.S. Provisional Patent Application Ser. No. 62/829,526 filed Apr. 4, 2019 and U.S. Provisional Patent Application Ser. No. 62/971,477 filed Feb. 7, 2020, the disclosures of which are expressly incorporated herein by reference.

STATEMENT REGARDING FEDERALLY SPONSORED RESEARCH

This invention was made with government support under Grant Nos. AI131722 and AI152693, awarded by the National Institutes of Health. The government has certain rights in the invention.

REFERENCE TO SEQUENCE LISTING

The Sequence Listing submitted Apr. 3, 2020, as a text file named "10644-095WO1_2020_04_03_ST25.txt," created on Apr. 3, 2020, and having a size of 4 MB is hereby incorporated by reference pursuant to 37 C.F.R. § 1.52 (e)(5).

FIELD

The present disclosure relates to antibodies and uses thereof for treating an HIV infection, an HCV infection, or an HIV/HCV co-infection.

BACKGROUND

HIV and HCV on their own are associated with devastating pathologies, affecting up to 200 million people combined. The prevalence of co-infection with these two pathogens is also high, estimated at 4-5 million people worldwide. While the global health burden of these viruses has been lessened significantly by the advent of highly active anti-retroviral therapy (HAART) and direct-acting antivirals (DAA) for HIV and HCV respectively, these therapies are expensive and require high patient compliance to often complex drug regimens. Furthermore, re-infection rates are high, especially for HIV/HCV co-infected individuals, which have been reported as having the highest risk of re-infection with either virus, with re-infection rates >20%. Therefore, even though effective drug therapies for HIV and HCV already exist, a number of factors including drug resistance, patient compliance, and likelihood of re-infection, strongly motivate work toward developing alternative therapeutic and prophylactic tools. Such new tools will be of great utility in the setting of HIV/HCV co-infection, where the chronic exposure to two constantly evolving pathogens leads to significantly exacerbated health problems compared to mono-infection with either pathogen. What is needed are novel compositions and methods for treating HIV and HCV mono-infections and HIV/HCV co-infection.

SUMMARY

Disclosed herein are recombinant antibodies and uses thereof for preventing, treating, inhibiting, or reducing HIV and/or HCV infection.

In some aspects, disclosed herein is a recombinant antibody, said antibody comprising a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRL3 comprises an amino acid sequence at least 60% identical to

```
                                    (SEQ ID NO: 13)
      MQPLQLPDT, (SEQ ID NO: 25)
      QQSYNVPT, (SEQ ID NO: 39)
      HQSSSLPFT, (SEQ ID NO: 49)
      QHFYSSPPT, (SEQ ID NO: 88)
      CLYAGSYSWV,
      or (SEQ ID NO: 101)
      QVWDSSSEHVV;
``` and/or

CDRH3 comprises an amino acid sequence at least 60% identical to

```
                                    (SEQ ID NO: 104)
      ARVAPPGVVNNKWFDI, (SEQ ID NO: 110)
      ARSEKRVTMTRKIKGRWFGP, (SEQ ID NO: 1817)
      CAAGLWSGDLSRPRYSDSW, (SEQ ID NO: 1818)
      CAKGLTTESRLEFW, (SEQ ID NO: 1819)
      CVSSWGPESPYYFDYW,
      or (SEQ ID NO: 1820)
      CAREYCTGGDCHFFLDYW.
```

In some embodiments, the CDRL3 comprises at least one amino acid substitution when compared to SEQ ID NO: 13, 25, 39, 49, 88, or 101.

In some embodiments, the at least one amino acid substitution is selected from the group consisting of a) at position 1 when compared to SEQ ID NO: 13, wherein the substituting amino acid residue is K;

b) at position 3 when compared to SEQ ID NO: 13, wherein the substituting amino acid residue is selected from the group consisting of A, T, G, V, D, Y, and F;

c) at position 6 when compared to SEQ ID NO: 13, wherein the substituting amino acid residue is selected from the group consisting of H, S, T, P, I, V, P, R, and V;

d) at position 9 when compared to SEQ ID NO: 13, wherein the substituting amino acid residue is selected from the group consisting of Y, L, H, P, I, G, C, J, R, and Q;

e) at position 5 when compared to SEQ ID NO: 25, wherein the substituting amino acid residue is selected from the group consisting of T, P, Y, R, I, G, and S;

f) at position 6 when compared to SEQ ID NO: 25, wherein the substituting amino acid residue is selected from the group consisting of A, T, and P;

g) at position 7 when compared to SEQ ID NO: 25, wherein the substituting amino acid residue is selected from the group consisting of W, A, R, G and L;

h) at position 3 when compared to SEQ ID NO: 39, wherein the substituting amino acid residue is T;

i) at position 4 when compared to SEQ ID NO: 39, wherein the substituting amino acid residue is selected from the group consisting of R, G, T, Y, A, and K;

j) at position 6 when compared to SEQ ID NO: 39, wherein the substituting amino acid residue is F;

k) at position 7 when compared to SEQ ID NO: 39, wherein the substituting amino acid residue is selected from the group consisting of G, Q, L, and S.

l) at position 8 when compared to SEQ ID NO: 39, wherein the substituting amino acid residue is selected from the group consisting of G, Q, Y, W, H, and L;

m) at position 9 when compared to SEQ ID NO: 39, wherein the substituting amino acid residue is selected from the group consisting of A, P, and S.

n) at position 3 when compared to SEQ ID NO: 49, wherein the substituting amino acid residue is L;

o) at position 5 when compared to SEQ ID NO: 49, wherein the substituting amino acid residue is T;

p) at position 6 when compared to SEQ ID NO: 49, wherein the substituting amino acid residue is selected from the group consisting of N, D, and K;

q) at position 2 when compared to SEQ ID NO: 88, wherein the substituting amino acid residue is selected from the group consisting of S, P and T;

r) at position 6 when compared to SEQ ID NO: 88, wherein the substituting amino acid residue is R;

s) at position 8 when compared to SEQ ID NO: 88, wherein the substituting amino acid residue is selected from the group consisting of N, W, and T;

t) at position 9 when compared to SEQ ID NO: 88, wherein the substituting amino acid residue is A;

u) at position 2 when compared to SEQ ID NO: 101, wherein the substituting amino acid residue is selected from the group consisting of M, A, and L;

v) at position 3 when compared to SEQ ID NO: 101, wherein the substituting amino acid residue is C;

w) at position 4 when compared to SEQ ID NO: 101, wherein the substituting amino acid residue is Y;

x) at position 7 when compared to SEQ ID NO: 101, wherein the substituting amino acid residue is N; and y) at position 8 when compared to SEQ ID NO: 101, wherein the substituting amino acid residue is D.

In some embodiments, the CDRL3 comprises an amino acid sequence selected from the group consisting of SEQ ID NOs: 1-12, 14-24, 26-38, 40-48, 50-87, and 89-100. In some embodiments, the CDRL3 comprises an amino acid sequence selected from the group consisting of SEQ ID NOs: 1-12, 14-24, 26-38, 40-48, 50-51, and 89-100.

In some embodiments, the VL comprises an amino acid sequence selected from the group consisting of SEQ ID NOs: 119-1693.

In some embodiments, the CDRL3 comprises an amino acid sequence selected from SEQ ID NOs: 13, 25, 39, 49, 88, 101, and 1883-1888. In some embodiments, the CDRL1 comprises an amino acid sequence selected from SEQ ID NOs: 13120-13125. In some embodiments, the CDRL2 comprises an amino acid sequence selected from SEQ ID NOs: 13126-13131.

In some embodiments, the VL comprises an amino acid sequence selected from SEQ ID NOs: 119, 227, 242, 351, 1399, 1406, and 1899-1904.

In some embodiments, the CDRH3 comprises at least one amino acid substitution when compared to SEQ ID NO: 104, 110, 1817, 1818, 1819, or 1820. In some embodiments, the at least one amino acid substitution is selected from the group consisting of a) at position 3 when compared to SEQ ID NO: 104, wherein the substituting amino acid residue is G or I;

b) at position 4 when compared to SEQ ID NO: 104, wherein the substituting amino acid residue is S, T, or P;

c) at position 9 when compared to SEQ ID NO: 104, wherein the substituting amino acid residue is A;

d) at position 11 when compared to SEQ ID NO: 104, wherein the substituting amino acid residue is K or H;

e) at position 14 when compared to SEQ ID NO: 104, wherein the substituting amino acid residue is L;

f) at position 16 when compared to SEQ ID NO: 104, wherein the substituting amino acid residue is L or T;

g) at position 1 when compared to SEQ ID NO: 110, wherein the substituting amino acid residue is T or S;

h) at position 5 when compared to SEQ ID NO: 110, wherein the substituting amino acid residue is N or P;

i) at position 7 when compared to SEQ ID NO: 110, wherein the substituting amino acid residue is I, N, K, or L;

j) at position 9 when compared to SEQ ID NO: 110, wherein the substituting amino acid residue is L or T;

k) at position 10 when compared to SEQ ID NO: 110, wherein the substituting amino acid residue is A or V;

l) at position 11 when compared to SEQ ID NO: 110, wherein the substituting amino acid residue is L.

m) at position 17 when compared to SEQ ID NO: 110, wherein the substituting amino acid residue is S;

n) at position 19 when compared to SEQ ID NO: 110, wherein the substituting amino acid residue is D; and o) at position 20 when compared to SEQ ID NO: 110, wherein the substituting amino acid residue is S.

In some embodiments, the CDRH3 comprises an amino acid sequence selected from the group consisting of SEQ ID NOs: 102-103, 105-109, and 111-118.

In some embodiments, the VH comprises an amino acid sequence selected from the group consisting of SEQ ID NOs: 1694-1756.

In some embodiments, the CDRH3 comprises an amino acid sequence selected from the group consisting of SEQ ID NOs: 104, 110, and 1817-1822. In some embodiments, the CDRH1 comprises an amino acid sequence selected from SEQ ID NOs: 13102-13107. In some embodiments, the CDRH2 comprises an amino acid sequence selected from SEQ ID NOs: 13108-13113.

In some embodiments, the VH comprises an amino acid sequence selected from the group consisting of SEQ ID NOs: 1895-1898, 1694, and 1718.

In some embodiments, the recombinant antibody disclosed herein is selected from the group consisting of a) a recombinant antibody comprising the CDRL3 of SEQ ID NO: 88 or 1887 and the CDRH3 of SEQ ID NO: 104 or 1821;

b) a recombinant antibody comprising the CDRL3 of SEQ ID NO: 101 or 1888 and the CDRH3 of SEQ ID NO: 110 or 1822;

c) a recombinant antibody comprising the CDRL3 of SEQ ID NO: 13 or 1883 and the CDRH3 of SEQ ID NO: 1817;

d) a recombinant antibody comprising the CDRL3 of SEQ ID NO: 25 or 1884 and the CDRH3 of SEQ ID NO: 1818;

e) a recombinant antibody comprising the CDRL3 of SEQ ID NO: 39 or 1885 and the CDRH3 of SEQ ID NO: 1819; and f) a recombinant antibody comprising the CDRL3 of SEQ ID NO: 49 or 1886 and the CDRH3 of SEQ ID NO: 1820.

In some embodiments, the recombinant antibody binds to at least one HIV antigen and/or at least one HCV antigen.

In some aspects, disclosed herein is a nucleic acid encoding the recombinant antibody of any preceding aspect.

In some aspects, disclosed herein is a host cell comprising the expression cassette or plasmid of any preceding aspect.

In some aspects, disclosed herein is a method of producing a recombinant antibody comprising cultivating or maintaining the host cell of any preceding aspect under conditions to produce said recombinant antibody.

In some aspects, disclosed herein is a method of treating, preventing, reducing, and/or inhibiting HIV/HCV co-infection comprising administering to a subject a therapeutically effective amount of the recombinant antibody of any preceding aspect.

In some aspects, disclosed herein is a method of treating, preventing, reducing, and/or inhibiting HIV infection comprising administering to a subject a therapeutically effective amount of the recombinant antibody of any preceding aspect.

In some aspects, disclosed herein is a method of treating, preventing, reducing, and/or inhibiting HCV infection comprising administering to a subject a therapeutically effective amount of the recombinant antibody of any preceding aspect.

DESCRIPTION OF DRAWINGS

The patent or application file contains at least one drawing executed in color. Copies of this patent or patent application publication with color drawing(s) will be provided by the Office upon request and payment of the necessary fee.

The accompanying figures, which are incorporated in and constitute a part of this specification, illustrate aspects described below.

FIG. 24A. Identified HIV/HCV mAbs show minimal polyreactivity as measured by ELISA binding to non-specific antigens: lipopolysaccharide (LPS), human recombinant insulin, and whole cell lysates (HEp-2, A549). FIG. 24B. Identified HIV/HCV mAbs show minimal polyreactivity as measured by ELISA binding to cardiolipin and nuclear antigens (ANA). FIG. 24C. HIV/HCV mAb180 shows no polyreactivity as measured by indirect immunofluorescence staining on HEp-2 cells. HIV/HCV mAb692 shows moderate polyreactivity as measured by indirect immunofluorescence staining on HEp-2 cells. DAPI-stained nuclei and FITC-conjugated antibody. FIG. 24D. This figure is cropped from images in FIG. 24C with DIC filter applied.

FIG. 29A shows mAb692 heavy chain development and relative positions of tested intermediate heavy chain sequences shown in various colors (left). Each of the colored heavy chain was paired with 692 light chain and tested for ELISA binding to recombinant HIV antigen (right). FIG. 29B shows mAb692 heavy chain development and relative positions of tested intermediate heavy chain sequences shown in various colors (left). Each of the colored heavy chain was paired with 692 light chain and tested for ELISA binding to recombinant HCV antigen (right).

FIGS. 31A-31B show that mAb180 acquired mutations are required for HIV recognition. FIG. 31A shows mAb180 heavy chain development and relative positions of tested intermediate heavy chain sequences shown in various colors (left). Each of the colored heavy chain was paired with 180 light chain and tested for ELISA binding to recombinant HIV antigen (right). FIG. 31B shows mAb180 heavy chain development and relative positions of tested intermediate heavy chain sequences shown in various colors (left). Each of the colored heavy chain was paired with 180 light chain and tested for ELISA binding to recombinant HCV antigen (right).

(FIG. 36A) LIBRA-Seq turns antigen-BCR interactions into "sequence-able" events. Antigen screening library size is constrained only by unique oligo barcodes. The technology allows for high throughput mapping of BCR specificity, and turns antigen-BCR interactions into "sequence-able" events, exponentially increasing screening library sizes. (FIG. 36B) Further, using LIBRA-seq one can map not only whether a given B cell was positive for an antigen, but which antigen(s) and substantially decrease functional validation time.

FIG. 49A shows PCR products at the correct size for the heavy chain gene run an agarose gel stained with EtBr.

FIG. 49B shows protein bands at the correct size for reduced and non-reduced antibody run on an SDS-PAGE gel stained with COOMASSIE™blue.

```
                                   (SEQ ID NO: 13144)
EVQLVESGPGLVKPSETLSLTCTVSGGSISYSSYYWGWIRQPPGKGLEWI

GSIYYSGSTYSNPSLKSRVTISVDTSKNQFSLKLSSVTAADTAVYYCARL

RWSSSWYYRFDYWGQGTLVTVSS;

(SEQ ID NO: 13145)
QLQLQESGPGLVKPSETLSLTCTVSGGSISSSSYYWGWIRQPPGKGLEWI

GSIYYSGSTYYNPSLKSRVTISVDTSKNQFSLKLSSVTAADTAVYYCARY

FDYWGQGTLVTVSS;

(SEQ ID NO: 13146)
QVQLVQSGGQMKKPGESMRISCRASGYEFIDCTLNWIRLAPGKRPEWMGW

LKPRGGAVNYARPLQGRVTMTRDVYSDTAFLELRSLTVDDTAVYFCTRGK

NCDYNWDFEHWGRGTPVIVSS;

(SEQ ID NO: 13147)
QVQLVQSGAEVKKPGASVKVSCKASGYTFTGYYMHWVRQAPGQGLEWMGW

INPNSGGTNYAQKFQGRVTMTRDTSISTAYMELSRLRSDDTAVYYCARAE

YFQHWGQGTLVTVSS.
```

Figure 55:
Figure 55:
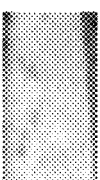
Figure 55:
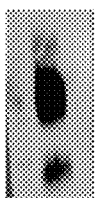
Figure 55:

FIG. 55 shows B12 antibody recognition to denatured proteins.

Figure 56:
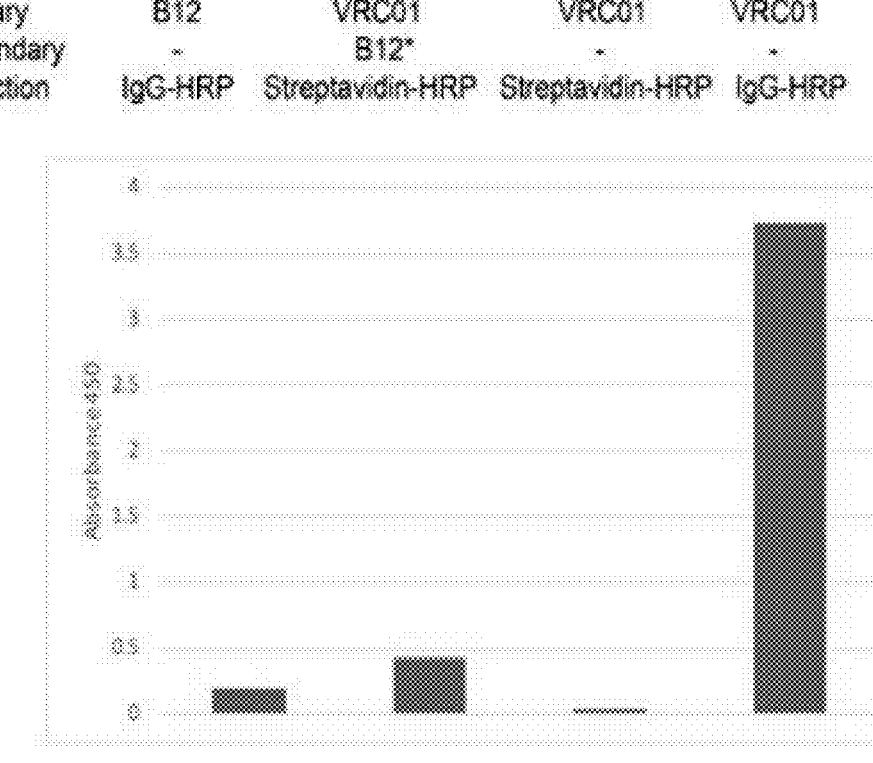
Figure 56:
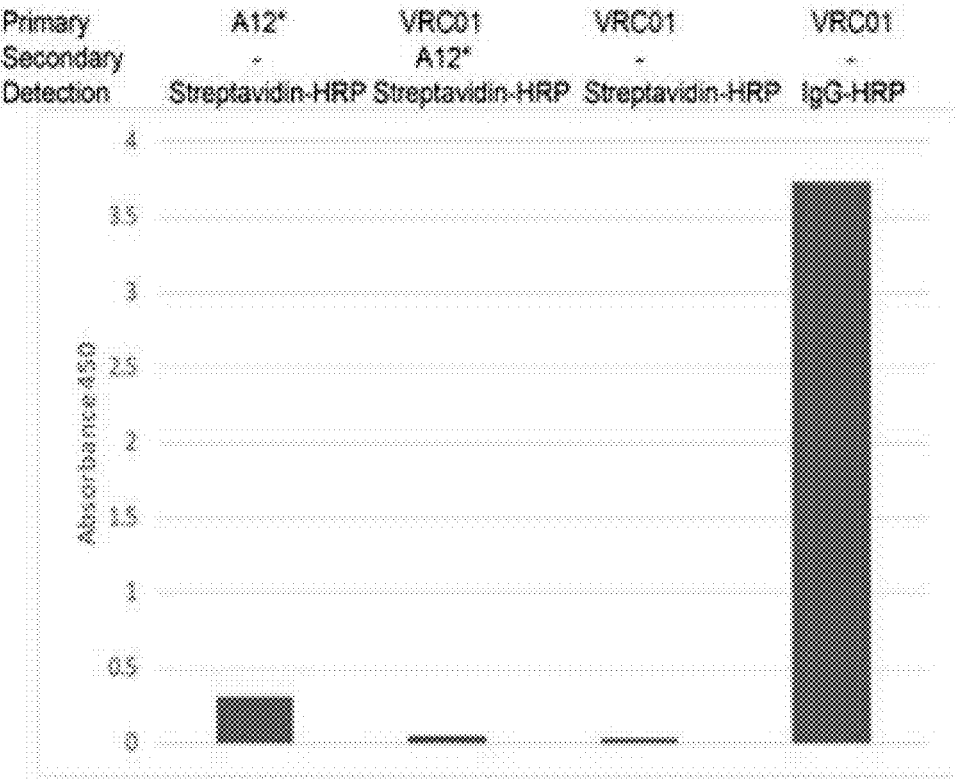
Figure 56:
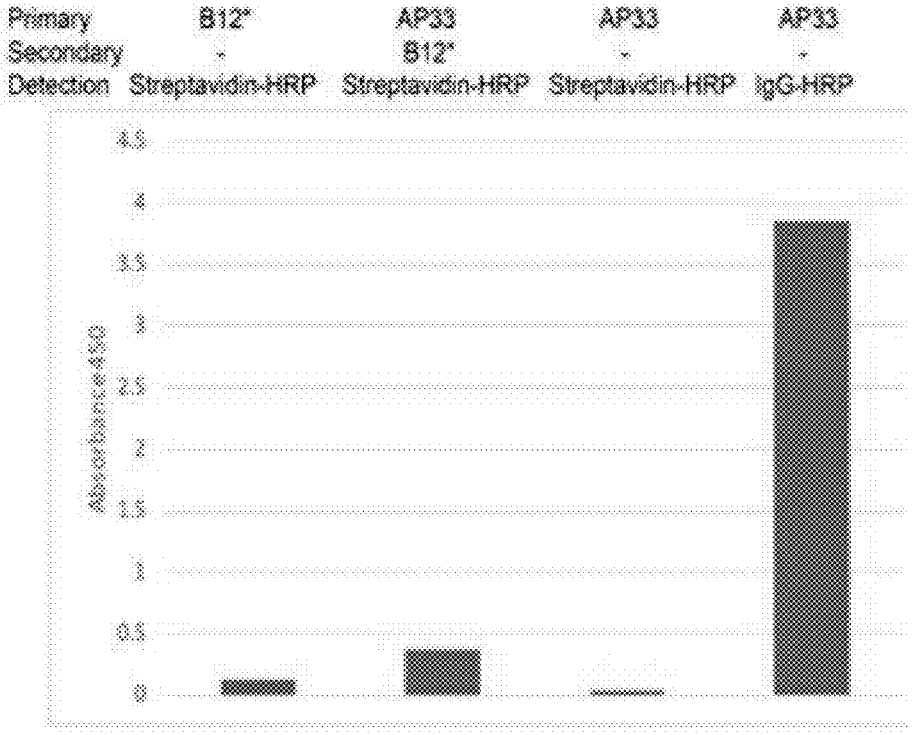
Figure 56:
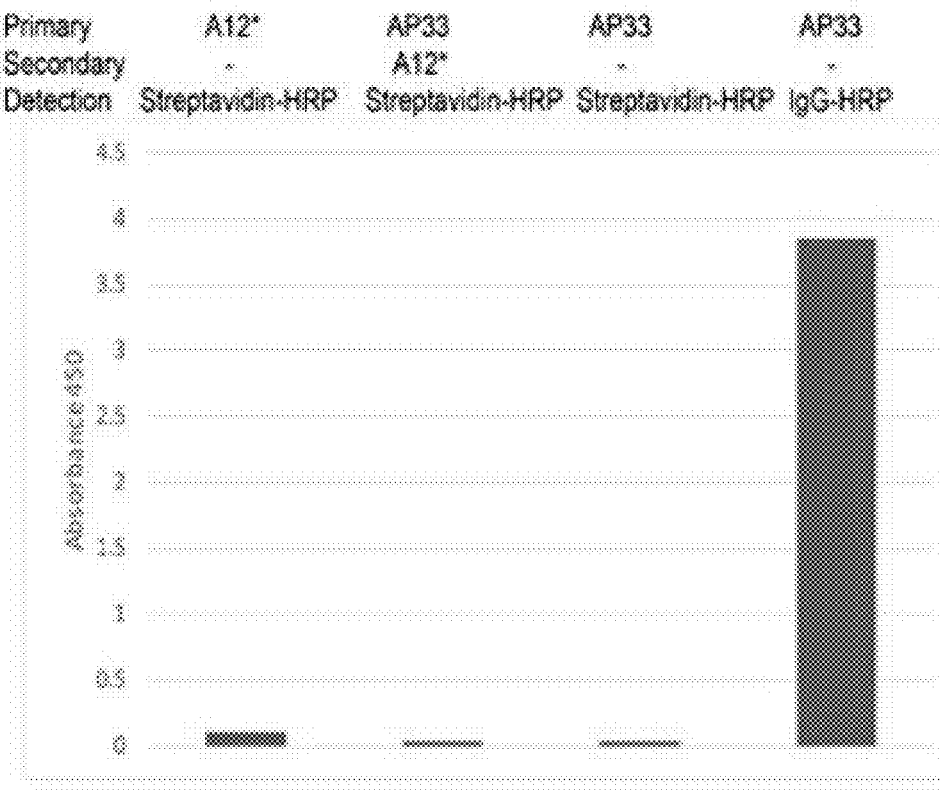

FIG. 56 shows that receptor binding site antibodies do not disrupt B12 binding.

Figure 57:
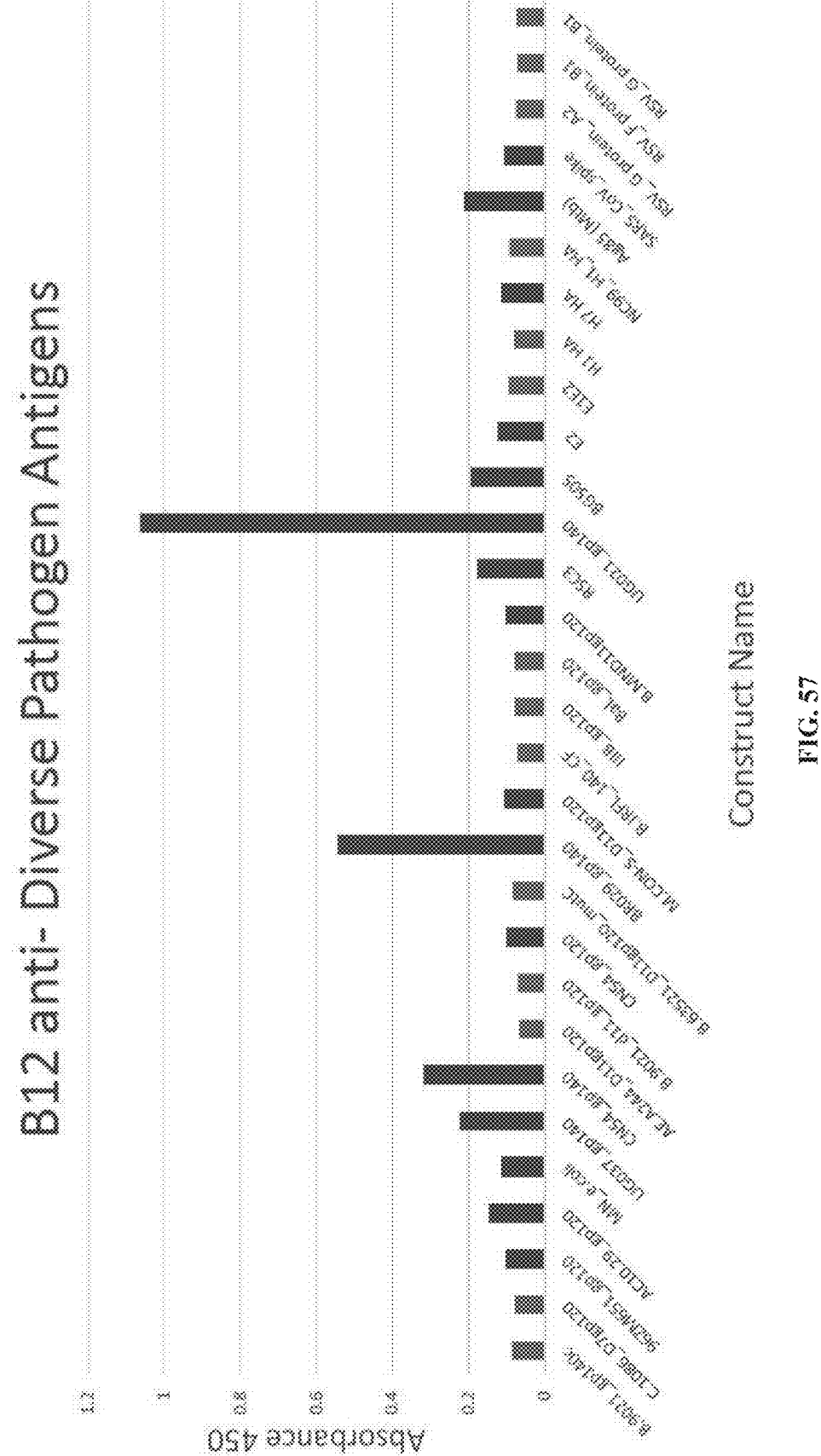

FIG. 57 shows that B12 antibody recognizes a wide range of pathogen antigens. Darker shading indicates B12 binding 3X background or more.

Figure 58:
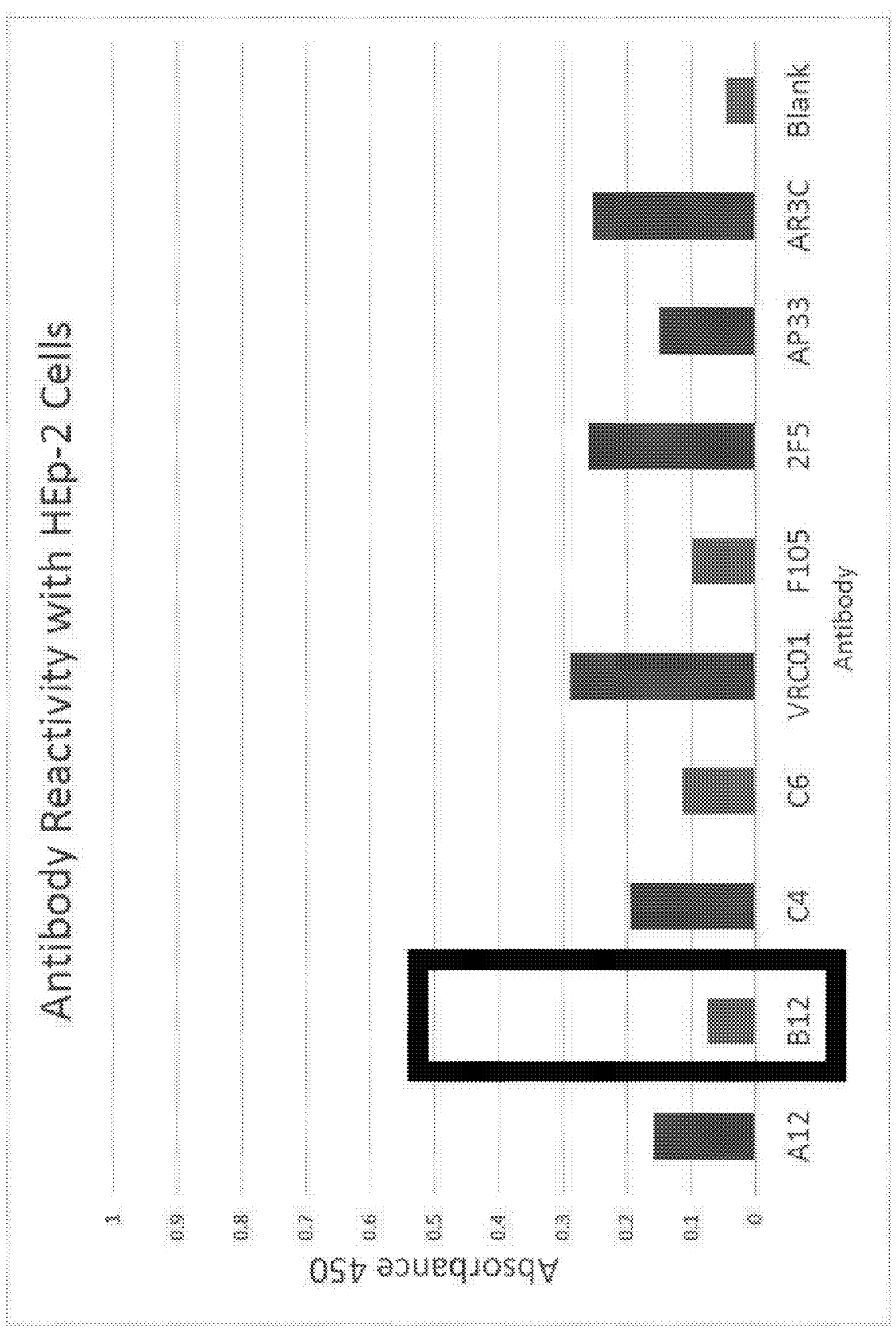

FIG. 58 shows that B12 is not polyreactive in HEp-2 ELISA.

Figure 59A:
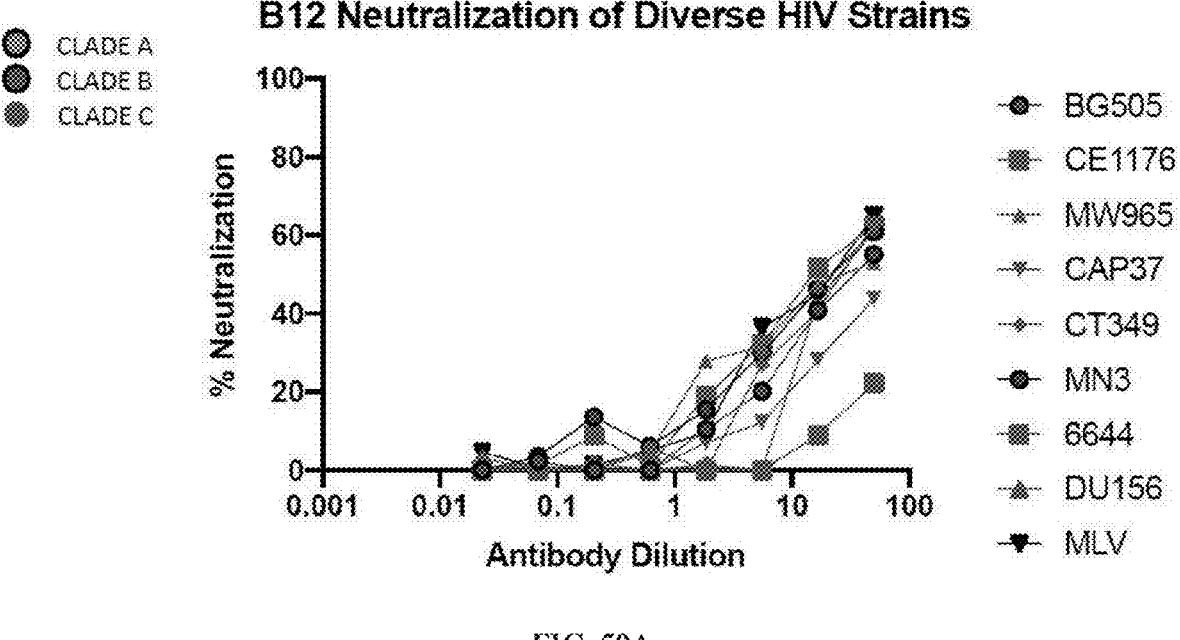
Figure 59B:
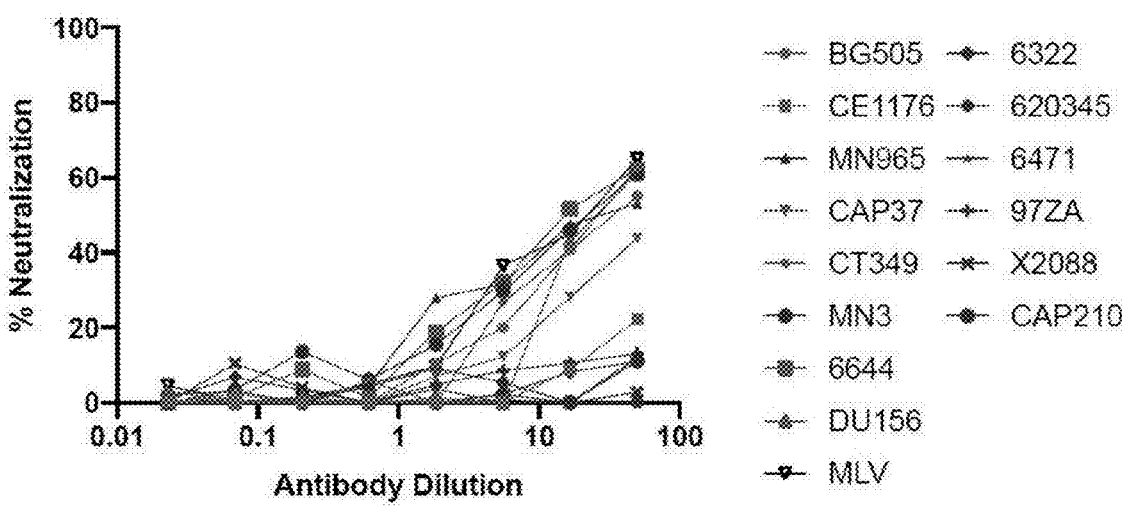

FIG. 59A-59B show antibody B12 neutralization. FIG. 59A shows levels of neutralization colored by HIV clade A: BG505 B: MN.3 C: CE1176, MW965, CAP37, CT349, 6644, DU156; Control: MLV; MLV env but the rest of the virus is HIV. FIG. 59B shows levels of neutralization colored according to HIV neutralization tier: Tier 1A: MN965, MN.3; Tier 1B: CAP37, CT349, 6644, DU156; Tier 2: BG505, CE1176; Tier 4:6322, 620345, 6471, 97ZA, X2088, CAP210 MLV.

FIG. 60 shows that B12 antibody neutralizes several HIV pseudotyped viruses. Shown is the concentration of antibody at which neutralization was 50% inhibited. IC50 was given in μg/ml.

Figure 61:
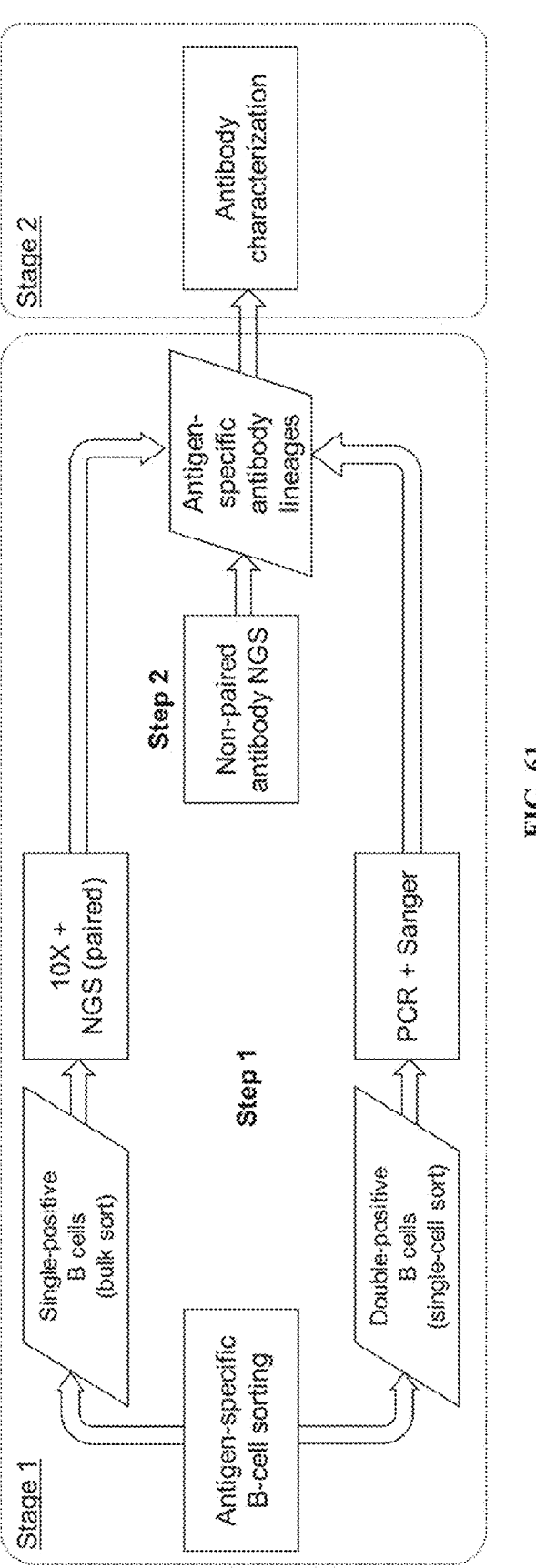

FIG. 61 shows experiment design for identifying antigen-specific antibodies in HIV/HCV co-infected individuals. Single-positive B cells (positive for either the HIV antigen probe or the HCV antigen probe) are the focus of step 1, whereas the double-positive B cells (positive for both the HIV and HCV antigen probes) are the focus of step 2.

Figures 62A, 62B:
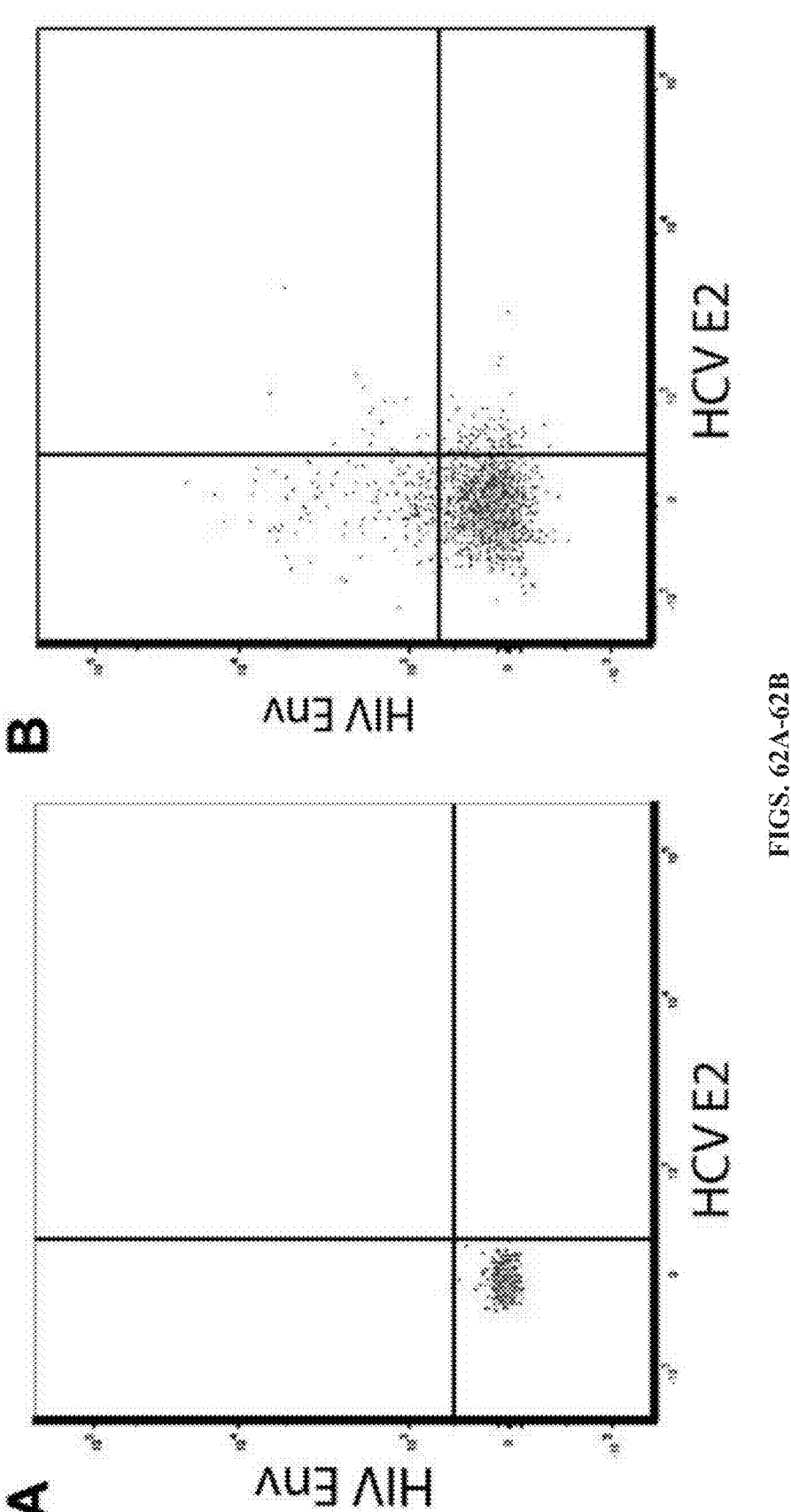

FIGS. 62A-62B shows identification of HIV- and HCV-specific B cells. PBMCs were stained for IgG+, memory B cells, as well as for HIV and HCV antigens, as described in the text. FIG. 62A shows that no antigen-positive B cells were identified from PBMCs from a non-infected individual. FIG. 62B shows that single- and double-antigen-positive B cells were identified from PBMCs from an HIV/HCV co-infected individual.

Figure 63:
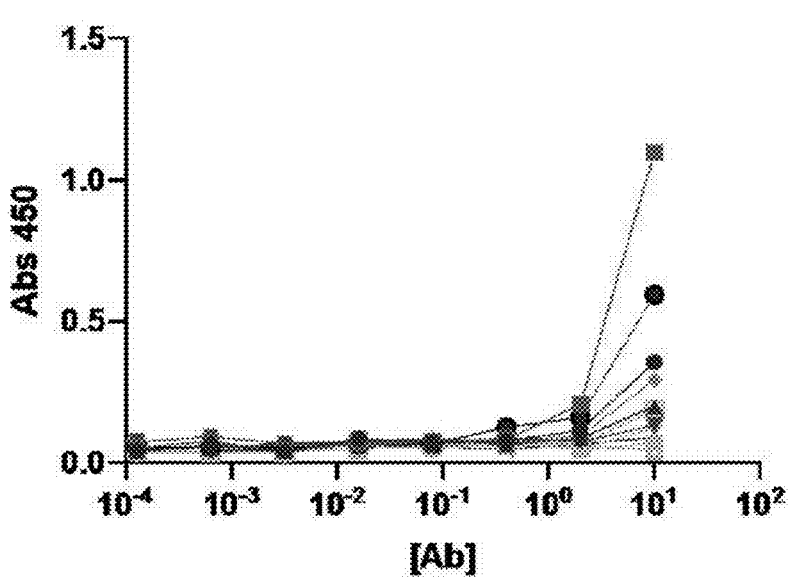
Figure 63:
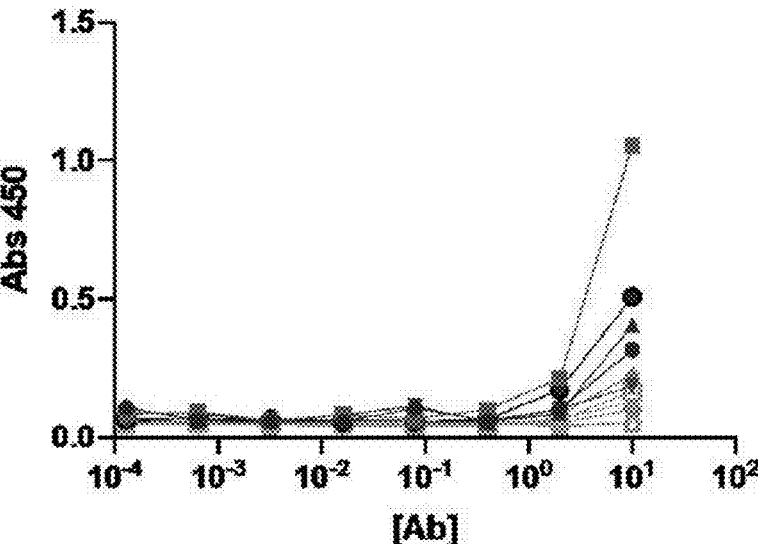

FIG. 63 shows HIV/HCV cross-reactive antibody binding to HIV (BG505.664.SOSIP) and HCV (HCV H77 E2core) antigens as measured by direct or sandwich ELISA.

Figure 64:
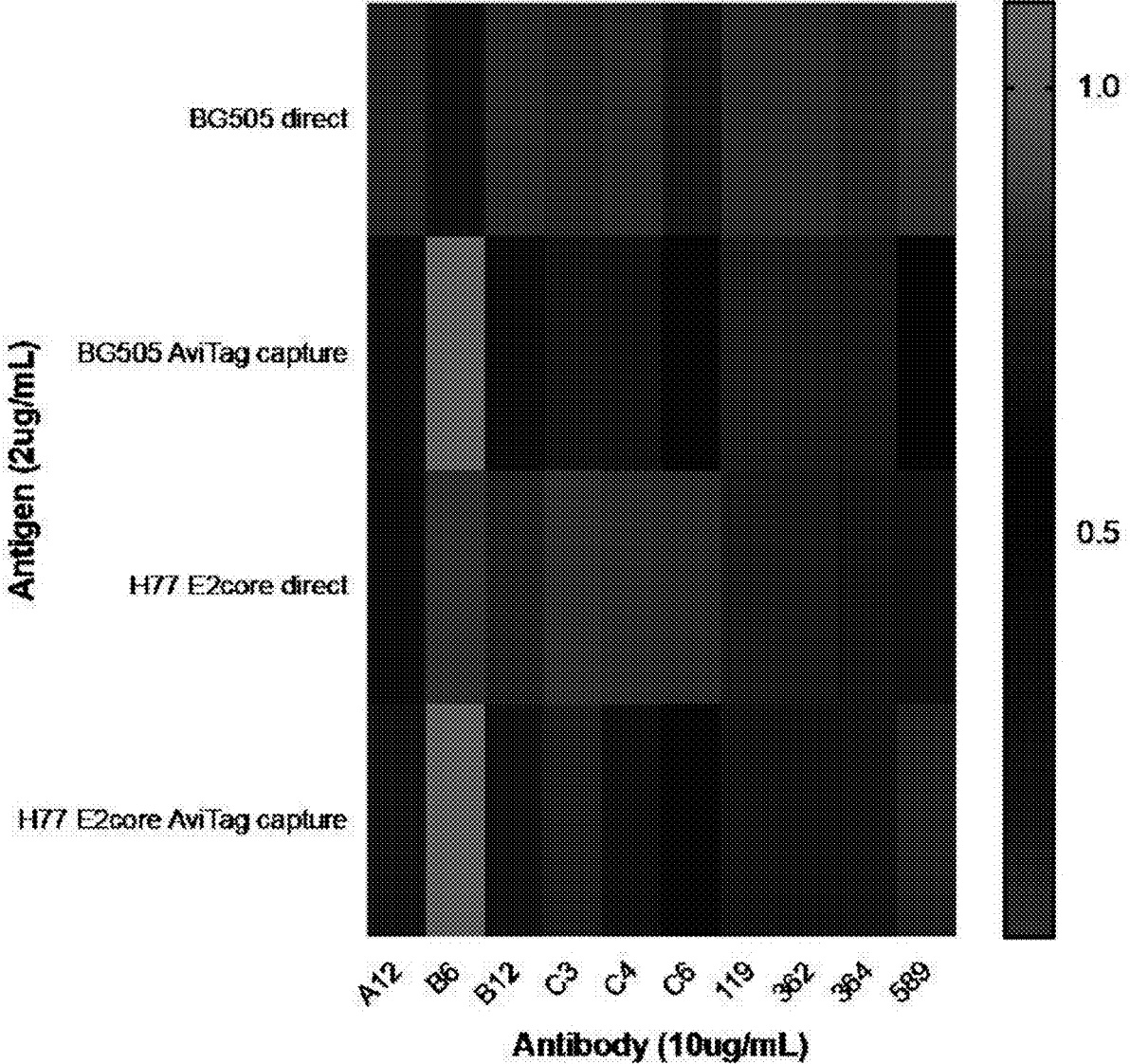

FIG. 64 shows the data from FIG. 63 displayed as a heatmap of ELISA binding.

Figure 65:
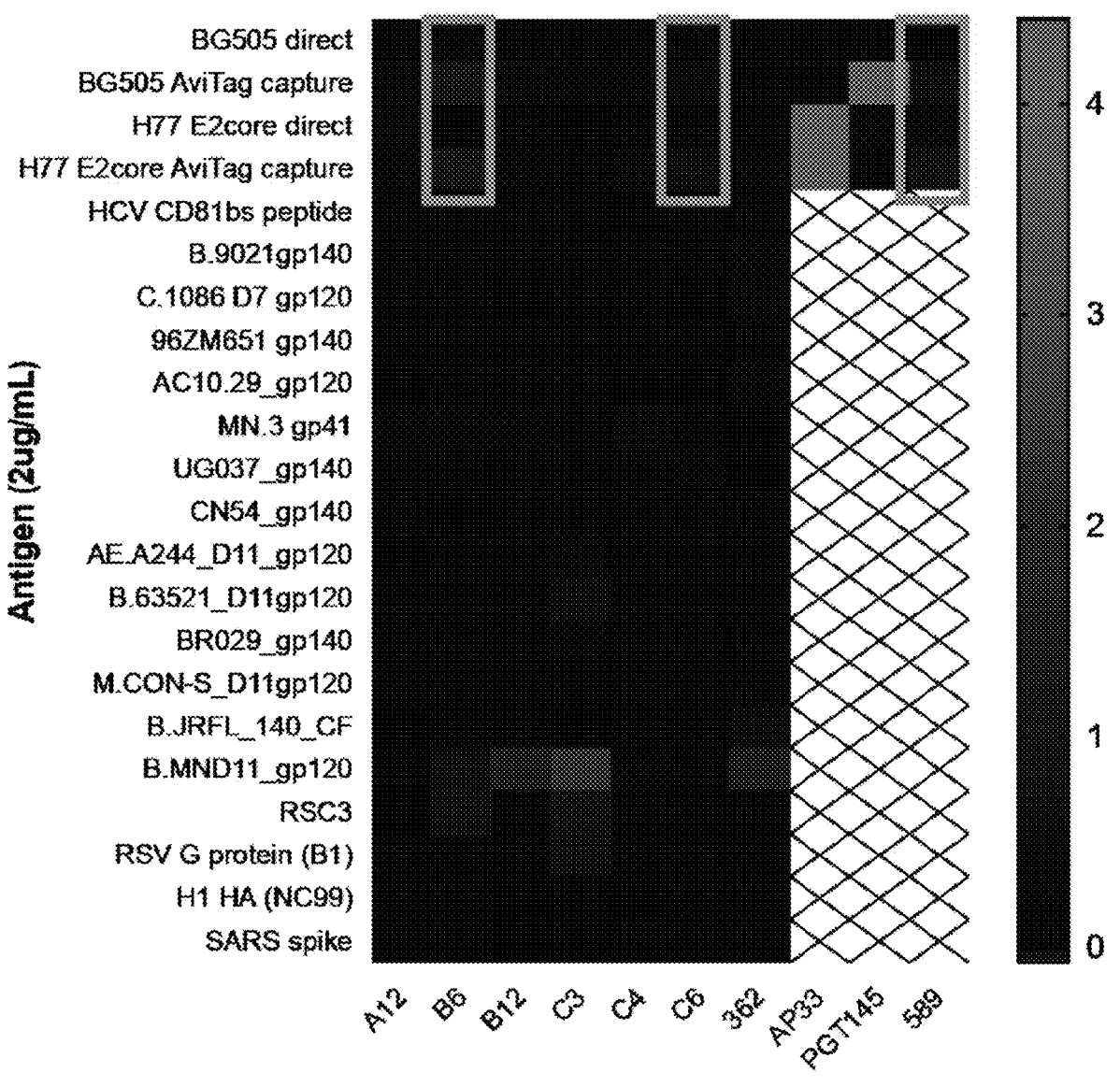

FIG. 65 shows ELISA binding of HIV/HCV mAbs to a panel of HIV and HCV antigens shown as a heatmap.

Figure 66:
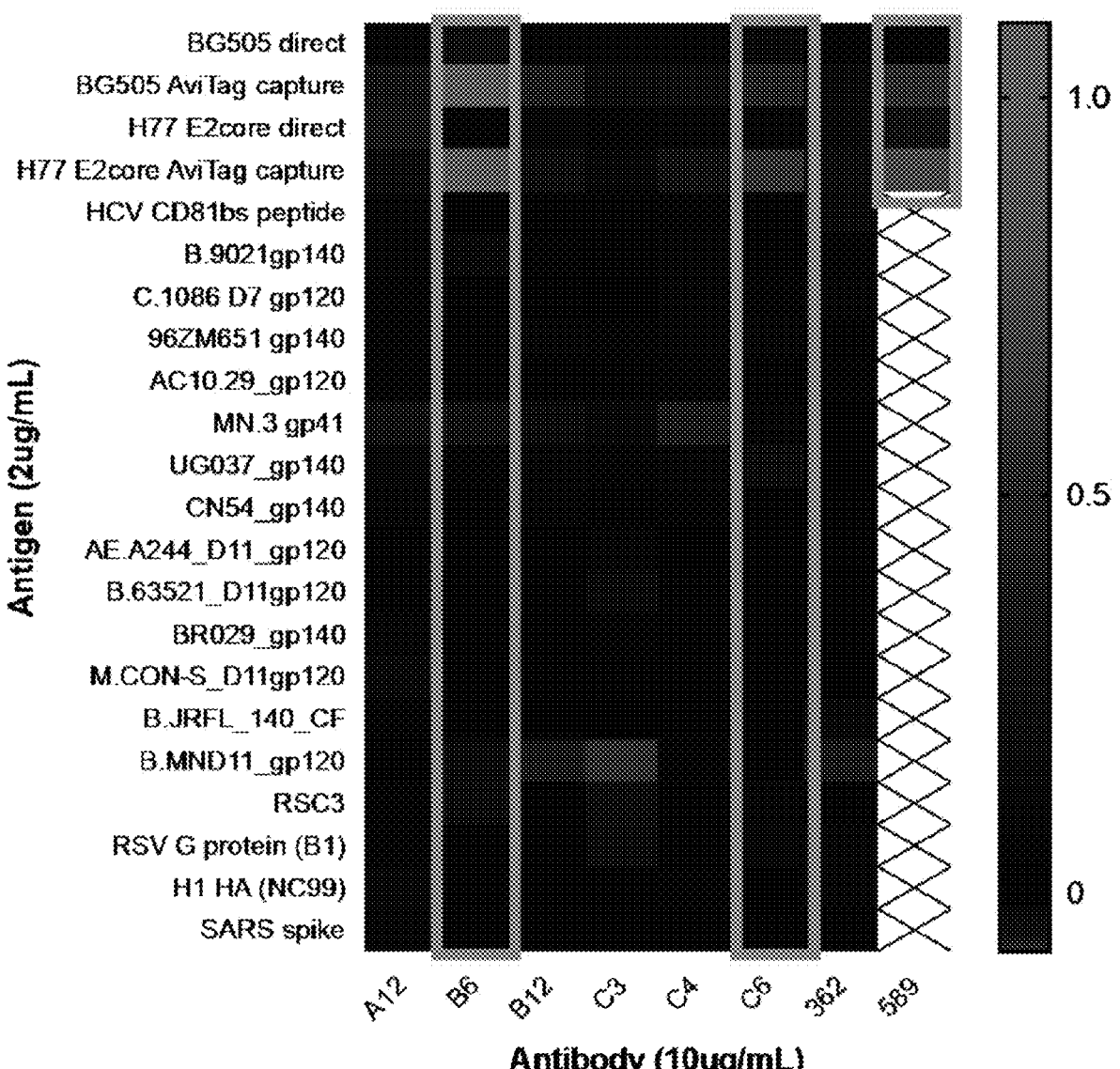

FIG. 66 shows same data as FIG. 65, minus AP33 and PGT145 antibody rows.

Figures 67A, 67B:
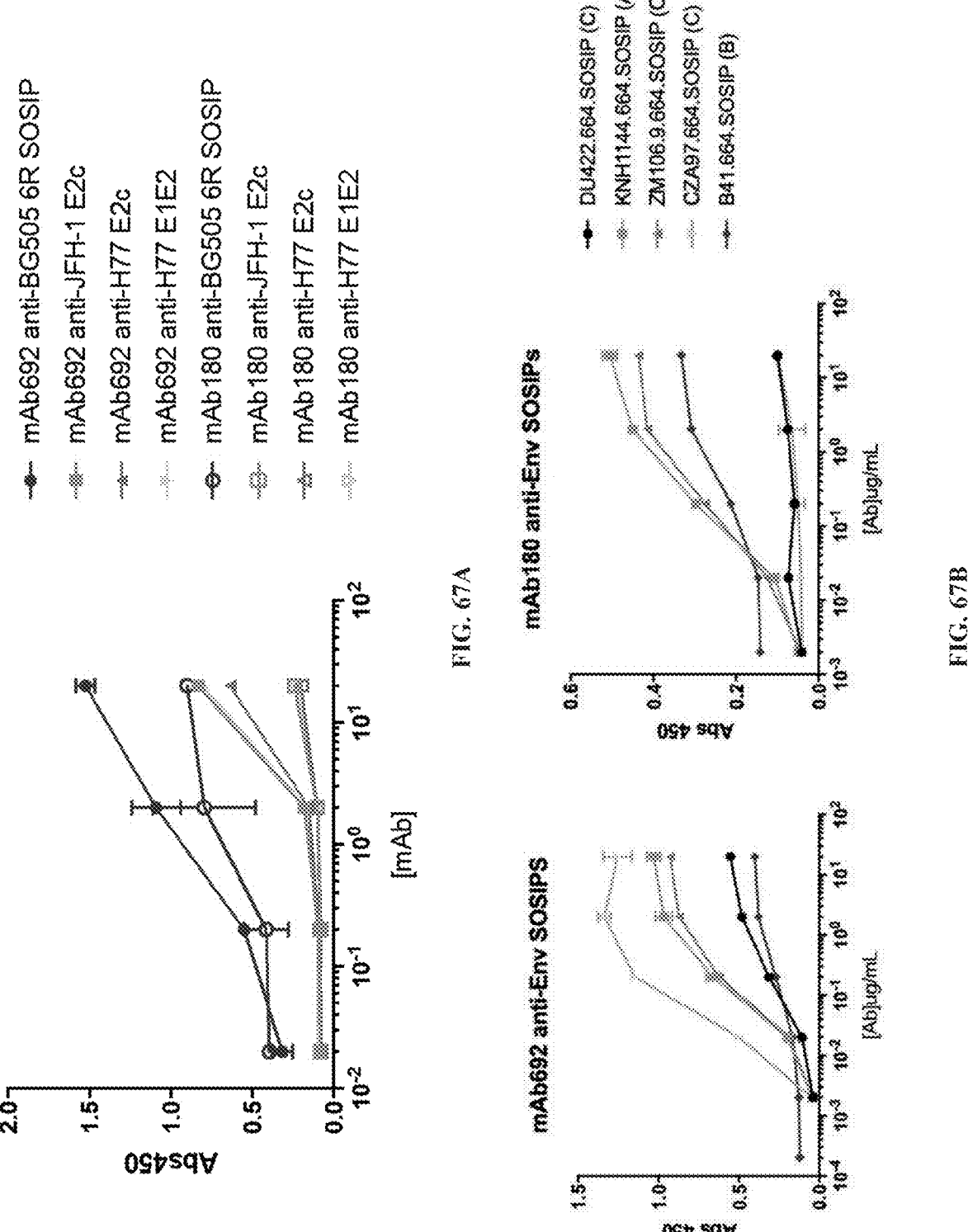
Figure 67C:
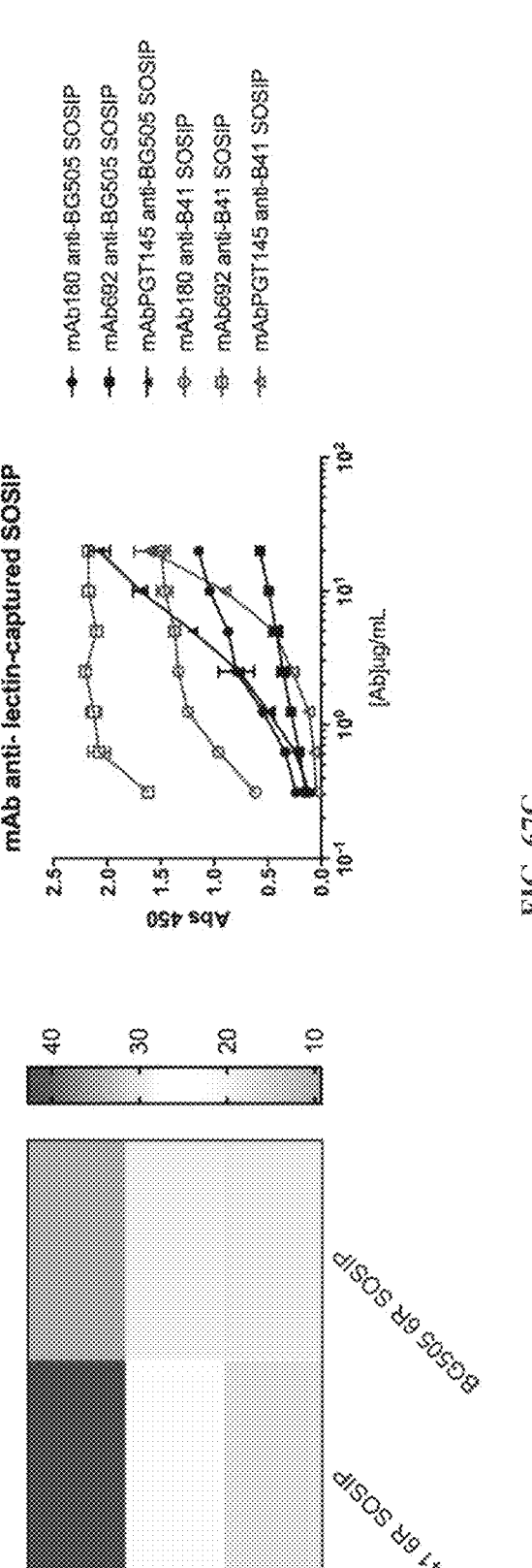

FIGS. 67A-67C show HIV/HCV cross-reactive antibody binding to HIV and HCV antigens as measured by lectin capture ELISA with antigens shown. In FIG. 67A, all antigens anti-AVITAG™ captured, blocked in 1% BSA and incubated at 37° C. In FIG. 67B, all antigens anti-AVITAG™ captured, blocked in 5% FBS and incubated at RT. In FIG. 67C, all antigens were lectin-captured, blocked in 5% FBS and incubated at RT.

Figure 68:
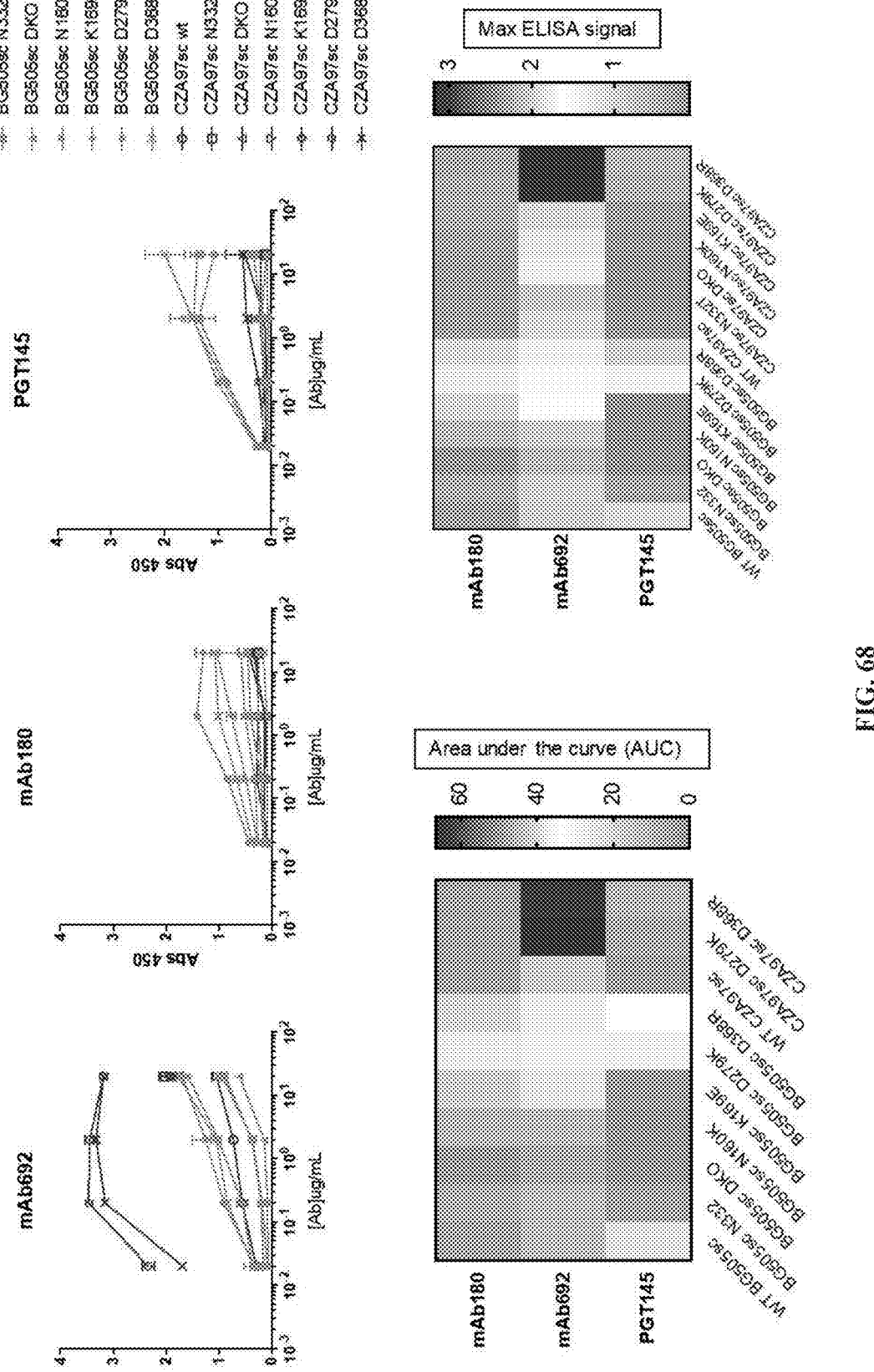

FIG. 68 shows HIV/HCV cross-reactive antibody binding to epitope knockout antigens to define where on the viral structure these antibodies bind. All antigens anti-AVITAG™ captured, blocked in 5% FBS and incubated at RT.

FIG. 69 shows HIV/HCV cross-reactive antibody binding to natively glycosylated and PNGase de-glycosylated HIV and HCV antigens.

FIG. 70 shows polyreactivity ELISA tests of mAb180 lineage members.

FIG. 71 shows mAb692 and relatives binding patterns.

Figure 72:
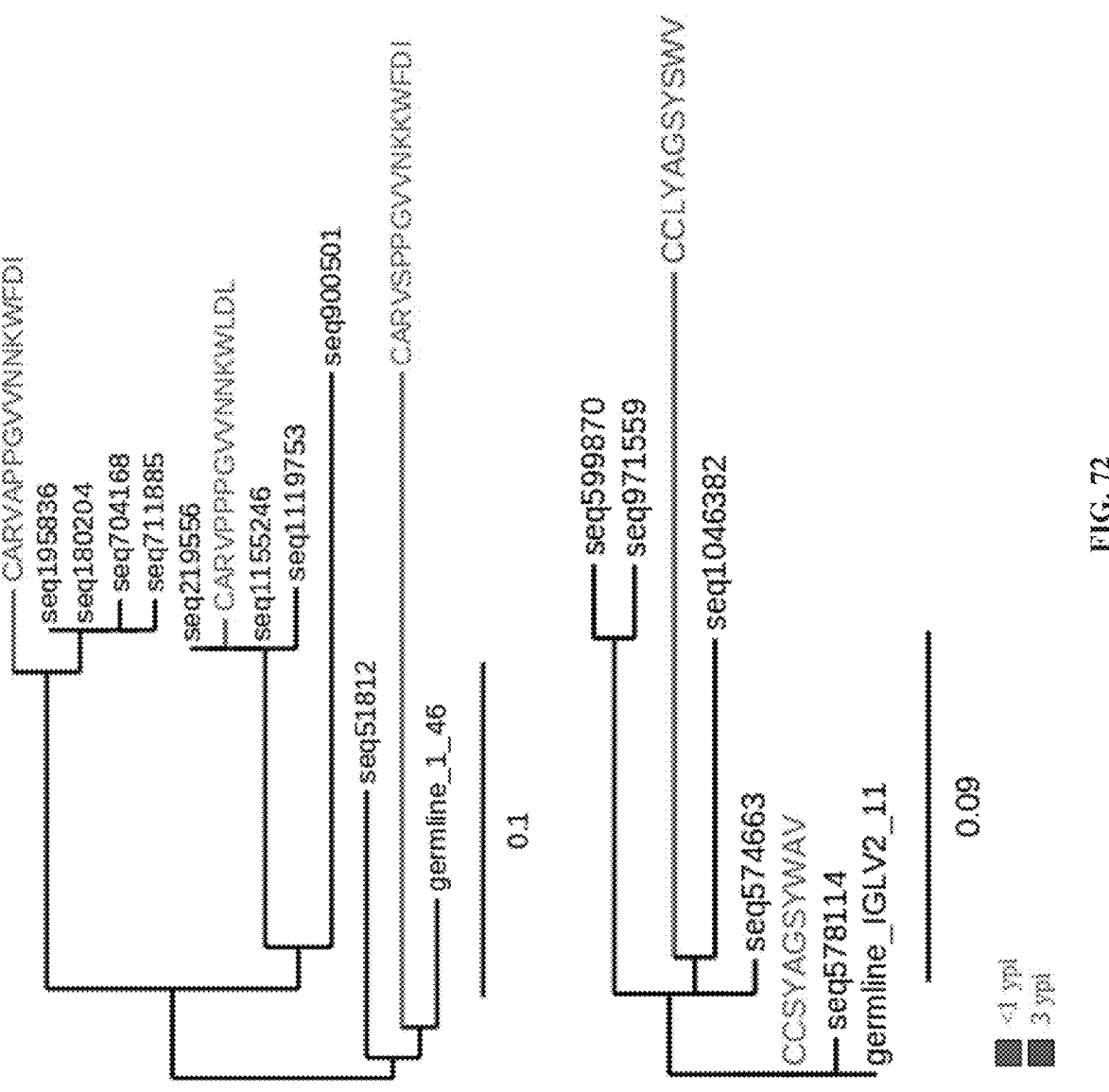

FIG. 72 shows mAb692 lineage tracing from <1 ypi. HIV/HCV cross-reactive antibodies identified in previous figures are shown in red. All other sequences in the tree are from 0.79ypi which were identified using unpaired NGS (ARCHER™ BCR IMMUNOVERSE™ kit). Sequences in FIG. 72: CARVAPPGVVNNKWFDI (SEQ ID NO: 13148); CARVPPPGVVNNKWLDL (SEQ ID NO: 13149); CARVSPPGVVNKKWFDI (SEQ ID NO: 13150); CCLY-AGSYSWV (SEQ ID NO: 13151); CCSYAGSYWAV (SEQ ID NO: 13152).

Figure 73A:
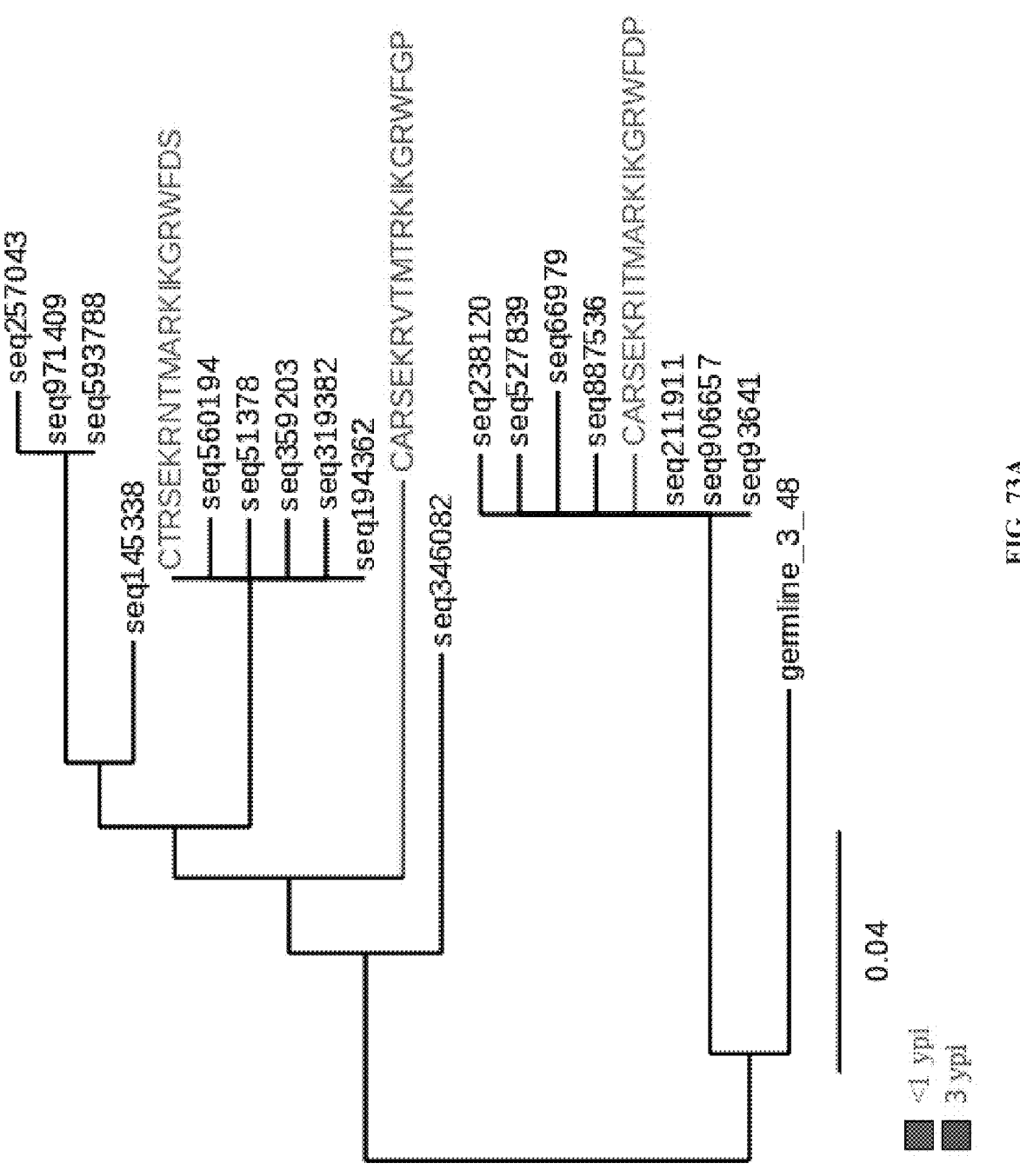
Figure 73B:
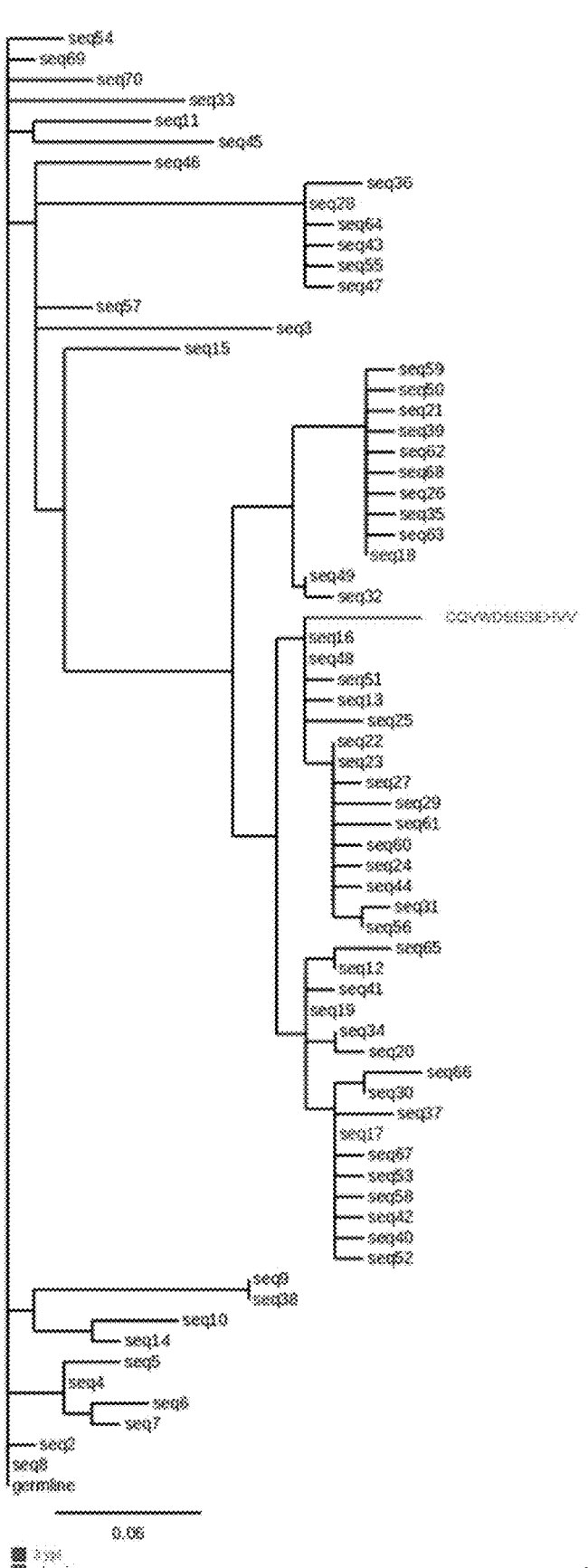

FIGS. 73A-73B show mAb180 lineage tracing from <1 ypi. HIV/HCV cross-reactive antibodies identified in previous figures are shown in red. All other sequences in the tree are from 0.79ypi which were identified using unpaired NGS (ARCHER™ BCR IMMUNOVERSE™ kit).

FIG. 73A shows the sequence development of mAb180 heavy chain and FIG. 73B shows mAb180 light chain. These figures were generated as maximum likelihood phylogenetic trees using PhyML. Sequences in FIG. 73A: CTRSEKRN-TMARKIKGRWFDS (SEQ ID NO: 13153); CARSEKRVTMTRKIKGRWFGP (SEQ ID NO: 13154); CARSEKRITMARKIKGRWFDP (SEQ ID NO: 13155). Sequences in FIG. 73B: CQVWDSSSEHVV (SEQ ID NO: 1888).

Figures 74A, 74B:
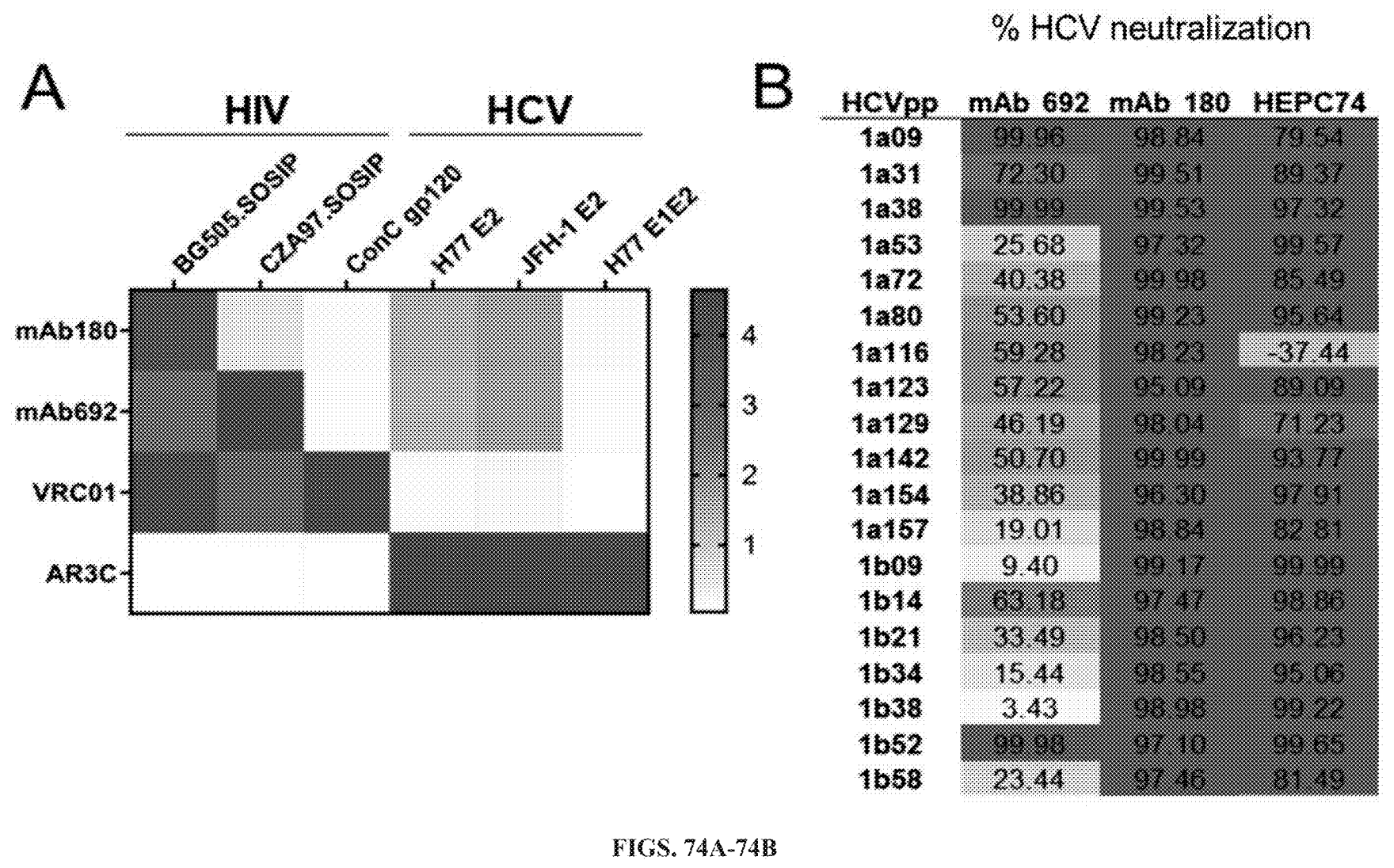

FIGS. 74A-74B show mAbs 180 and 692 show cross-reactive binding and HCV neutralization. FIG. 74A shows newly identified mAbs 180 and 692 cross-reactive binding confirmed by ELISA (heatmap of average Abs450 values at 20 μg/ml ab, from duplicates); VRC01 (HIV) and AR3C (HCV) are shown as controls. FIG. 74B shows exceptional HCV neutralization breadth for mAb 180 against a panel of 19 HCV pseudoparticles, shown as % neutralized virus at 100 μg/ml ab. The prior broadest known HEPC74 neutralization antibody is shown as a control.

Figure 75:
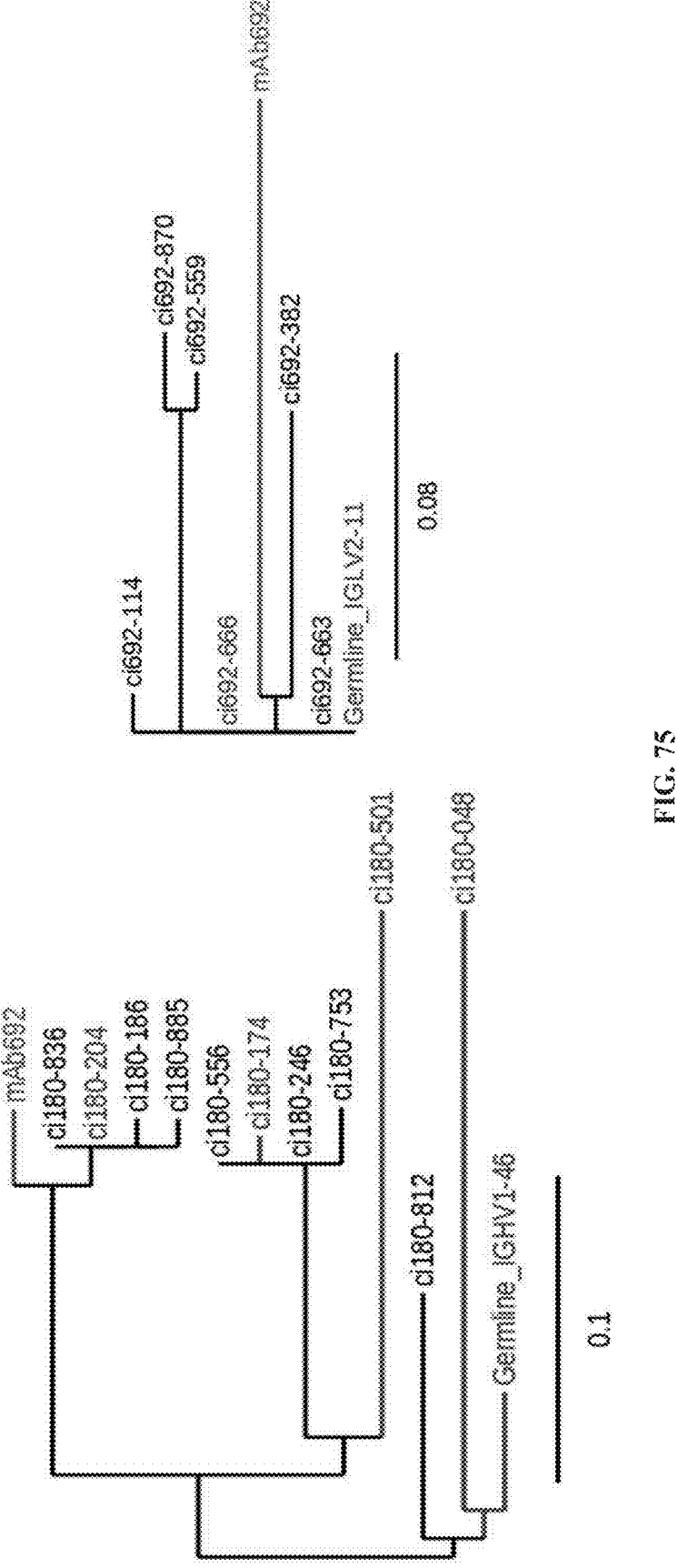

FIG. 75 shows mAb692 evolution.

DETAILED DESCRIPTION

HIV/HCV co-infection is remarkably common, affecting 4-5 million people worldwide. Shared routes of transmission and high endemic areas contribute to high rates of re-infection and rapid viral spread. While the global health burden of these viruses has been lessened significantly by the advent of highly active antiretroviral therapy (HAART) and direct-acting antivirals (DAA) for HIV and HCV respectively, these therapies are expensive and require high patient compliance to often complex drug regimens, leading to questions of their realistic efficacy. Given this, developing novel therapeutics and vaccines remains a world health priority.

Utilized primarily for their incredible specificity, polyreactive antibodies can confer a selective advantage in the fight against highly mutable pathogens such as HIV and HCV. Current antibody-based vaccine design efforts are focused on eliciting broadly neutralizing antibodies (bNAbs), yet how these multi-specific antibodies are elicited remains unclear. To interrogate the limits of this viral polyreactivity, virus-specific antibody responses in HIV/HCV coinfection are investigated. In order to identify HIV/HCV cross-reactive antibodies, antigen-specific B cell sorting of infected peripheral blood mononuclear cells were used. Using fluorescence-activated cell sorting with fluorescently-labeled antigen probes, multiple antibodies that recognize both HIV and HCV envelope proteins with varying binding strengths were identified. The current disclosure shows the first evidence of antibody cross-reactivity across virus species.

Therefore, in some aspects, disclosed herein are recombinant antibodies that specifically binds a viral protein of HIV and/or a viral protein of HCV and uses thereof for treating/preventing/inhibiting/reducing HIV/HCV co-infection, as well as HIV and HCV mono-infections.

Reference will now be made in detail to the embodiments of the invention, examples of which are illustrated in the drawings and the examples. This invention may, however, be embodied in many different forms and should not be construed as limited to the embodiments set forth herein.

Unless defined otherwise, all technical and scientific terms used herein have the same meaning as commonly understood to one of ordinary skill in the art to which this disclosure belongs. The term "comprising" and variations thereof as used herein is used synonymously with the term "including" and variations thereof and are open, non-limiting terms. Although the terms "comprising" and "including" have been used herein to describe various embodiments, the terms "consisting essentially of" and "consisting of" can be used in place of "comprising" and "including" to provide for more specific embodiments and are also disclosed. As used in this disclosure and in the appended claims, the singular forms "a", "an", "the", include plural referents unless the context clearly dictates otherwise.

The following definitions are provided for the full understanding of terms used in this specification.

Terminology

The term "about" as used herein when referring to a measurable value such as an amount, a percentage, and the like, is meant to encompass variations of ±20%, ±10%, ±5%, or ±1% from the measurable value.

"Administration" to a subject or "administering" includes any route of introducing or delivering to a subject an agent. Administration can be carried out by any suitable route, including oral, intravenous, intraperitoneal, intranasal, inhalation and the like. Administration includes self-administration and the administration by another.

As used herein, the terms "may," "optionally," and "may optionally" are used interchangeably and are meant to include cases in which the condition occurs as well as cases in which the condition does not occur. Thus, for example, the statement that a formulation "may include an excipient" is meant to include cases in which the formulation includes an excipient as well as cases in which the formulation does not include an excipient.

As used herein, the term "subject" or "host" can refer to living organisms such as mammals, including, but not limited to humans, livestock, dogs, cats, and other mammals. Administration of the therapeutic agents can be carried out at dosages and for periods of time effective for treatment of a subject. In some embodiments, the subject is a human.

As used herein, the term "antigen" refers to a molecule that is capable of binding to an antibody. In some embodiments, the antigen stimulates an immune response such as by production of antibodies specific for the antigen.

In the present invention, "specific for" and "specificity" means a condition where one of the molecules is involved in selective binding. Accordingly, an antibody that is specific for one antigen selectively binds that antigen and not other antigens.

The term "antibodies" is used herein in a broad sense and includes both polyclonal and monoclonal antibodies. In addition to intact immunoglobulin molecules, also included in the term "antibodies" are fragments or polymers of those immunoglobulin molecules, and human or humanized versions of immunoglobulin molecules or fragments thereof. The antibodies can be tested for their desired activity using the in vitro assays described herein, or by analogous methods, after which their in vivo therapeutic and/or prophylactic activities are tested according to known clinical testing methods. Native antibodies are usually heterotetrameric glycoproteins of about 150,000 daltons, composed of two identical light (L) chains and two identical heavy (H) chains. Each heavy chain has at one end a variable domain (VH) followed by a number of constant domains. Each light chain has a variable domain at one end (VL) and a constant domain at its other end. There are five major classes of human immunoglobulins: IgA, IgD, IgE, IgG and IgM, and several of these may be further divided into subclasses (isotypes), e.g., IgG-1, IgG-2, IgG-3, and IgG-4; IgA-1 and IgA-2. One skilled in the art would recognize the comparable classes for mouse. The heavy chain constant domains that correspond to the different classes of immunoglobulins are called alpha, delta, epsilon, gamma, and mu, respectively.

Each antibody molecule is made up of the protein products of two genes: heavy-chain gene and light-chain gene. The heavy-chain gene is constructed through somatic recombination of V, D, and J gene segments. In human, there are 51 VH, 27 DH, 6 JH, 9 CH gene segments on human chromosome 14. The light-chain gene is constructed through somatic recombination of V and J gene segments. There are 40 Vκ, 31 Vλ, 5 Jκ, 4 Jλ gene segments on human chromosome 14 (80 VJ). The heavy-chain constant domains that correspond to the different classes of immunoglobulins are called α, δ, ε, γ, and μ, respectively. The "light chains" of antibodies from any vertebrate species can be assigned to one of two clearly distinct types, called kappa (κ) and lambda (λ), based on the amino acid sequences of their constant domains.

The term "monoclonal antibody" as used herein refers to an antibody obtained from a substantially homogeneous population of antibodies, i.e., the individual antibodies within the population are identical except for possible naturally occurring mutations that may be present in a small subset of the antibody molecules. The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, as long as they exhibit the desired antagonistic activity.

The disclosed monoclonal antibodies can be made using any procedure which produces monoclonal antibodies. For example, disclosed monoclonal antibodies can be prepared using hybridoma methods, such as those described by Kohler and Milstein, Nature, 256:495 (1975). In a hybridoma method, a mouse or other appropriate host animal is typically immunized with an immunizing agent to elicit lymphocytes that produce or are capable of producing antibodies that will specifically bind to the immunizing agent. Alternatively, the lymphocytes may be immunized in vitro.

The monoclonal antibodies may also be made by recombinant DNA methods. DNA encoding the disclosed monoclonal antibodies can be readily isolated and sequenced using conventional procedures (e.g., by using oligonucleotide probes that are capable of binding specifically to genes encoding the heavy and light chains of murine antibodies). Libraries of antibodies or active antibody fragments can also be generated and screened using phage display techniques, e.g., as described in U.S. Pat. No. 5,804,440 to Burton et al. and U.S. Pat. No. 6,096,441 to Barbas et al.

In vitro methods are also suitable for preparing monovalent antibodies. Digestion of antibodies to produce fragments thereof, particularly, Fab fragments, can be accomplished using routine techniques known in the art. For instance, digestion can be performed using papain. Examples of papain digestion are described in WO 94/29348 published Dec. 22, 1994 and U.S. Pat. No. 4,342,566. Papain digestion of antibodies typically produces two identical antigen binding fragments, called Fab fragments, each with a single antigen binding site, and a residual Fc fragment. Pepsin treatment yields a fragment that has two antigen combining sites and is still capable of cross-linking antigen.

As used herein, the term "antibody or antigen binding fragment thereof" or "antibody or fragments thereof" encompasses chimeric antibodies and hybrid antibodies, with dual or multiple antigen or epitope specificities, and fragments, such as F(ab')2, Fab', Fab, Fv, sFv, scFv, nano-antibody and the like, including hybrid fragments. Thus, fragments of the antibodies that retain the ability to bind their specific antigens are provided. Such antibodies and fragments can be made by techniques known in the art and can be screened for specificity and activity according to the methods set forth in the Examples and in general methods for producing antibodies and screening antibodies for specificity and activity (See Harlow and Lane. Antibodies, A Laboratory Manual. Cold Spring Harbor Publications, New York, (1988)).

The fragments, whether attached to other sequences or not, can also include insertions, deletions, substitutions, or other selected modifications of particular regions or specific amino acids residues, provided the activity of the antibody or antibody fragment is not significantly altered or impaired compared to the non-modified antibody or antibody fragment. These modifications can provide for some additional property, such as to remove/add amino acids capable of disulfide bonding, to increase its bio-longevity, to alter its secretory characteristics, etc. In any case, the antibody or antibody fragment must possess a bioactive property, such as specific binding to its cognate antigen. Functional or active regions of the antibody or antibody fragment may be identified by mutagenesis of a specific region of the protein, followed by expression and testing of the expressed polypeptide. Such methods are readily apparent to a skilled practitioner in the art and can include site-specific mutagenesis of the nucleic acid encoding the antibody or antibody fragment. (Zoller, M. J. Curr. Opin. Biotechnol. 3:348-354, 1992).

As used herein, the term "antibody" or "antibodies" can also refer to a human antibody and/or a humanized antibody. Many non-human antibodies (e.g., those derived from mice, rats, or rabbits) are naturally antigenic in humans, and thus can give rise to undesirable immune responses when administered to humans. Therefore, the use of human or humanized antibodies in the methods serves to lessen the chance that an antibody administered to a human will evoke an undesirable immune response.

The terms "antigen binding site", "binding site" and "binding domain" refer to the specific elements, parts or amino acid residues of a polypeptide, such as an antibody, that bind the antigenic determinant or epitope.

An "antibody heavy chain," as used herein, refers to the larger of the two types of polypeptide chains present in all antibody molecules in their naturally occurring conformations.

An "antibody light chain," as used herein, refers to the smaller of the two types of polypeptide chains present in all antibody molecules in their naturally occurring conformations, K and A light chains refer to the two major antibody light chain isotypes.

The term "CDR" as used herein refers to the "complementarity determining regions" of the antibody which consist of the antigen binding loops. (Kabat E. A. et al., (1991) Sequences of proteins of immunological interest. NIH Publication 91-3242). Each of the two variable domains of an antibody Fv fragment contain, for example, three CDRs.

The term "hypervariable region" or "HVR", as used herein, refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the complementarity determining regions (CDRs), the latter being of highest sequence variability and/or involved in antigen recognition. With the exception of CDR1 in VH, CDRs generally comprise the amino acid residues that form the hypervariable loops. Hypervariable regions (HVRs) are also referred to as "complementarity determining regions" (CDRs), and these terms are used herein interchangeably in reference to portions of the variable region that form the antigen-binding regions. The amino acid sequence boundaries of a CDR can be determined by one of skill in the art using any of a number of known numbering schemes, including those described by Kabat et al., supra ("Kabat" numbering scheme): Al-Lazikani et al., 1997. J. Mol. Biol., 273:927-948 ("Chothia" numbering scheme); MacCallum et al., 1996, J. Mol. Biol, 262:732-745 ("Contact" numbering scheme); Lefranc et al., Dev. Comp. Immunol., 2003, 27:55-77 ("IMGT" numbering scheme); and Honegge and Pluckthun, J. Mol. Biol., 2001, 309:657-70 ("AHo" numbering scheme); each of which is incorporated by reference in its entirety.

"Composition" refers to any agent that has a beneficial biological effect. Beneficial biological effects include both therapeutic effects, e.g., treatment of a disorder or other undesirable physiological condition, and prophylactic effects, e.g., prevention of a disorder or other undesirable physiological condition. The terms also encompass pharmaceutically acceptable, pharmacologically active derivatives of beneficial agents specifically mentioned herein, including, but not limited to, a bacterium, a vector, polynucleotide, cells, salts, esters, amides, proagents, active metabolites, isomers, fragments, analogs, and the like. When the term "composition" is used, then, or when a particular composition is specifically identified, it is to be understood that the term includes the composition per se as well as pharmaceutically acceptable, pharmacologically active vector, polynucleotide, salts, esters, amides, proagents, conjugates, active metabolites, isomers, fragments, analogs, etc. In some aspects, the composition disclosed herein comprises a recombinant antibody that specifically binds to a HIV and/or HCV antigen.

"Effective amount" encompasses, without limitation, an amount that can ameliorate, reverse, mitigate, prevent, or diagnose a symptom or sign of a medical condition or disorder. Unless dictated otherwise, explicitly or by context, an "effective amount" is not limited to a minimal amount sufficient to ameliorate a condition. The severity of a disease or disorder, as well as the ability of a treatment to prevent, treat, or mitigate, the disease or disorder can be measured, without implying any limitation, by a biomarker or by a clinical parameter. In some embodiments, the term "effective amount of a recombinant antibody" refers to an amount of a recombinant antibody sufficient to prevent, treat, or mitigate a HIV/HCV coinfection, HIV mono-infection, and/or HCV mono-infection.

The "fragments" or "functional fragments," whether attached to other sequences or not, can include insertions, deletions, substitutions, or other selected modifications of particular regions or specific amino acids residues, provided the activity of the fragment is not significantly altered or impaired compared to the nonmodified peptide or protein. These modifications can provide for some additional property, such as to remove or add amino acids capable of disulfide bonding, to increase its bio-longevity, to alter its secretory characteristics, etc. In any case, the functional fragment must possess a bioactive property, such as binding to HIV and/or HCV antigen, and/or ameliorating the viral infection.

The term "identity" or "homology" shall be construed to mean the percentage of nucleotide bases or amino acid residues in the candidate sequence that are identical with the bases or residues of a corresponding sequence to which it is compared, after aligning the sequences and introducing gaps, if necessary to achieve the maximum percent identity for the entire sequence, and not considering any conservative substitutions as part of the sequence identity. A polynucleotide or polynucleotide region (or a polypeptide or polypeptide region) that has a certain percentage (for example, 80%, 85%, 90%, or 95%) of "sequence identity" to another sequence means that, when aligned, that percentage of bases (or amino acids) are the same in comparing the two sequences. This alignment and the percent homology or sequence identity can be determined using software programs known in the art. Such alignment can be provided using, for instance, the method of Needleman et al. (1970) J. Mol. Biol. 48:443-453, implemented conveniently by computer programs such as the Align program (DNAstar, Inc.).

The term "increased" or "increase" as used herein generally means an increase by a statically significant amount;

for example, "increased" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

As used herein, the terms "nanobody", "$V_HH$", "$V_HH$ antibody fragment" and "single domain antibody" are used indifferently and designate a variable domain of a single heavy chain of an antibody of the type found in Camelidae, which are without any light chains, such as those derived from Camelids as described in PCT Publication No. WO 94/04678, which is incorporated by reference in its entirety.

The term "reduced", "reduce", "reduction", or "decrease" as used herein generally means a decrease by a statistically significant amount. However, for avoidance of doubt, "reduced" means a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (i.e. absent level as compared to a reference sample), or any decrease between 10-100% as compared to a reference level.

"Nucleotide," "nucleoside," "nucleotide residue," and "nucleoside residue," as used herein, can mean a deoxyribonucleotide, ribonucleotide residue, or another similar nucleoside analogue. A nucleotide is a molecule that contains a base moiety, a sugar moiety and a phosphate moiety. Nucleotides can be linked together through their phosphate moieties and sugar moieties creating an internucleoside linkage. The base moiety of a nucleotide can be adenin-9-yl (A), cytosin-1-yl (C), guanin-9-yl (G), uracil-1-yl (U), and thymin-1-yl (T). The sugar moiety of a nucleotide is a ribose or a deoxyribose. The phosphate moiety of a nucleotide is pentavalent phosphate. A non-limiting example of a nucleotide would be 3'-AMP (3'-adenosine monophosphate) or 5'-GMP (5'-guanosine monophosphate). There are many varieties of these types of molecules available in the art and available herein.

The method and the system disclosed here including the use of primers, which are capable of interacting with the disclosed nucleic acids, such as the antigen barcode as disclosed herein. In certain embodiments the primers are used to support DNA amplification reactions. Typically, the primers will be capable of being extended in a sequence specific manner. Extension of a primer in a sequence specific manner includes any methods wherein the sequence and/or composition of the nucleic acid molecule to which the primer is hybridized or otherwise associated directs or influences the composition or sequence of the product produced by the extension of the primer. Extension of the primer in a sequence specific manner therefore includes, but is not limited to, PCR, DNA sequencing, DNA extension, DNA polymerization, RNA transcription, or reverse transcription. Techniques and conditions that amplify the primer in a sequence specific manner are preferred. In certain embodiments the primers are used for the DNA amplification reactions, such as PCR or direct sequencing. It is understood that in certain embodiments the primers can also be extended using non-enzymatic techniques, where for example, the nucleotides or oligonucleotides used to extend the primer are modified such that they will chemically react to extend the primer in a sequence specific manner. Typically, the disclosed primers hybridize with the disclosed nucleic acids or region of the nucleic acids or they hybridize with the complement of the nucleic acids or complement of a region of the nucleic acids.

The term "amplification" refers to the production of one or more copies of a genetic fragment or target sequence, specifically the "amplicon". As it refers to the product of an amplification reaction, amplicon is used interchangeably with common laboratory terms, such as "PCR product."

The term "polypeptide" refers to a compound made up of a single chain of D- or L-amino acids or a mixture of D- and L-amino acids joined by peptide bonds.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA.

An "expression cassette" refers to a DNA coding sequence or segment of DNA that code for an expression product that can be inserted into a vector at defined restriction sites. The cassette restriction sites are designed to ensure insertion of the cassette in the proper reading frame. Generally, foreign DNA is inserted at one or more restriction sites of the vector DNA, and then is carried by the vector into a host cell along with the transmissible vector DNA. A segment or sequence of DNA having inserted or added DNA, such as an expression vector, can also be called a "DNA construct".

Expression vectors comprise the expression cassette and additionally usually comprise an origin for autonomous replication in the host cells or a genome integration site, one or more selectable markers (e.g. an amino acid synthesis gene or a gene conferring resistance to antibiotics such as zeocin, kanamycin, G418 or hygromycin), a number of restriction enzyme cleavage sites, a suitable promoter sequence and a transcription terminator, which components are operably linked together. The term "vector" as used herein includes autonomously replicating nucleotide sequences as well as genome integrating nucleotide sequences. A common type of vector is a "plasmid", which generally is a self-contained molecule of double-stranded DNA that can readily accept additional (foreign) DNA and which can readily be introduced into a suitable host cell. A plasmid vector often contains coding DNA and promoter DNA and has one or more restriction sites suitable for inserting foreign DNA. Specifically, the term "vector" or "plasmid" refers to a vehicle by which a DNA or RNA sequence (e.g. a foreign gene) can be introduced into a host cell, so as to transform the host and promote expression (e.g. transcription and translation) of the introduced sequence.

The term "host cell" as used herein shall refer to primary subject cells trans-formed to produce a particular recombinant protein, such as an antibody as described herein, and any progeny thereof. It should be understood that not all progeny are exactly identical to the parental cell (due to deliberate or inadvertent mutations or differences in environment), however, such altered progeny are included in these terms, so long as the progeny retain the same functionality as that of the originally transformed cell. The term "host cell line" refers to a cell line of host cells as used for expressing a recombinant gene to produce recombinant polypeptides such as recombinant antibodies. The term "cell line" as used herein refers to an established clone of a particular cell type that has acquired the ability to proliferate over a prolonged period of time. Such host cell or host cell line may be maintained in cell culture and/or cultivated to produce a recombinant polypeptide.

The term "gene" or "gene sequence" refers to the coding sequence or control sequence, or fragments thereof. A gene may include any combination of coding sequence and control sequence, or fragments thereof. Thus, a "gene" as referred to herein may be all or part of a native gene. A polynucleotide sequence as referred to herein may be used interchangeably with the term "gene", or may include any coding sequence, non-coding sequence or control sequence, fragments thereof, and combinations thereof. The term "gene" or "gene sequence" includes, for example, control sequences upstream of the coding sequence (for example, the ribosome binding site).

"Pharmaceutically acceptable carrier" (sometimes referred to as a "carrier") means a carrier or excipient that is useful in preparing a pharmaceutical or therapeutic composition that is generally safe and non-toxic, and includes a carrier that is acceptable for veterinary and/or human pharmaceutical or therapeutic use. The terms "carrier" or "pharmaceutically acceptable carrier" can include, but are not limited to, phosphate buffered saline solution, water, emulsions (such as an oil/water or water/oil emulsion) and/or various types of wetting agents.

As used herein, the term "carrier" encompasses any excipient, diluent, filler, salt, buffer, stabilizer, solubilizer, lipid, stabilizer, or other material well known in the art for use in pharmaceutical formulations. The choice of a carrier for use in a composition will depend upon the intended route of administration for the composition. The preparation of pharmaceutically acceptable carriers and formulations containing these materials is described in, e.g., *Remington's Pharmaceutical Sciences,* 21st Edition, ed. University of the Sciences in Philadelphia, Lippincott, Williams & Wilkins, Philadelphia, PA, 2005. Examples of physiologically acceptable carriers include saline, glycerol, DMSO, buffers such as phosphate buffers, citrate buffer, and buffers with other organic acids; antioxidants including ascorbic acid; low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™ (ICI, Inc.; Bridgewater, New Jersey), polyethylene glycol (PEG), and PLURONICS™ (BASF; Florham Park, NJ). To provide for the administration of such dosages for the desired therapeutic treatment, compositions disclosed herein can advantageously comprise between about 0.1% and 99% by weight of the total of one or more of the subject compounds based on the weight of the total composition including carrier or diluent.

The term "specificity" refers to the number of different types of antigens or antigenic determinants to which a particular antigen-binding molecule (such as the recombinant antibody of the invention) can bind. As used herein, the term "specifically binds," as used herein with respect to a recombinant antibody refers to the recombinant antibody's preferential binding to one or more epitopes as compared with other epitopes. Specific binding can depend upon binding affinity and the stringency of the conditions under which the binding is conducted. In one example, an antibody specifically binds an epitope when there is high affinity binding under stringent conditions.

It should be understood that the specificity of an antigen-binding molecule (e.g., the recombinant antibodies of the present invention) can be determined based on affinity and/or avidity. The affinity, represented by the equilibrium constant for the dissociation of an antigen with an antigen-binding molecule ($K_D$), is a measure for the binding strength between an antigenic determinant and an antigen-binding site on the antigen-binding molecule: the lesser the value of the $K_D$, the stronger the binding strength between an antigenic determinant and the antigen-binding molecule (alternatively, the affinity can also be expressed as the affinity constant ($K_A$), which is $1/K_D$). As will be clear to the skilled person (for example on the basis of the further disclosure herein), affinity can be determined in a manner known per se, depending on the specific antigen of interest. Avidity is the measure of the strength of binding between an antigen-binding molecule (such as the recombinant antibodies of the present invention) and the pertinent antigen. Avidity is related to both the affinity between an antigenic determinant and its antigen binding site on the antigen-binding molecule and the number of pertinent binding sites present on the antigen-binding molecule. Typically, antigen-binding proteins (such as the recombinant antibodies of the invention) will bind to their antigen with a dissociation constant ($K_D$) of $10^{-5}$ to $10^{-12}$ moles/liter or less, and preferably $10^{-7}$ to $10^{-12}$ moles/liter or less, and more preferably $10^{-8}$ to $10^{-12}$ moles/liter.

"Therapeutically effective amount" refers to the amount of a composition such as recombinant antibody that will elicit the biological or medical response of a tissue, system, animal, or human that is being sought by the researcher, veterinarian, medical doctor or other clinician over a generalized period of time. In some embodiments, a desired response is reduction of HIV and/or HCV titers in a subject. In some embodiments, the desired response is mitigation of HIV/HCV co-infection or HIV/HCV mono-infection and/or related symptoms. In some instances, a desired biological or medical response is achieved following administration of multiple dosages of the composition to the subject over a period of days, weeks, or years. The therapeutically effective amount will vary depending on the composition, the disorder or conditions and its severity, the route of administration, time of administration, rate of excretion, drug combination, judgment of the treating physician, dosage form, and the age, weight, general health, sex and/or diet of the subject to be treated. The therapeutically effective amount of recombinant antibodies as described herein can be determined by one of ordinary skill in the art.

A therapeutically significant reduction in a symptom is, e.g. at least about 10%, at least about 20%, at least about 30%, at least about 40%, at least about 50%, at least about 60%, at least about 70%, at least about 80%, at least about 90%, at least about 100%, at least about 125%, at least about 150% or more in a measured parameter as compared to a control or non-treated subject. Measured or measurable parameters include clinically detectable markers of disease, for example, elevated or depressed levels of a biological marker, such as decreased viral titers, decreased viral RNA levels, increase in CD4 T lymphocyte counts, and/or prolonged survival of a subject. It will be understood, that the total daily usage of the compositions and formulations as disclosed herein will be decided by the attending physician within the scope of sound medical judgment. The exact amount required will vary depending on factors such as the type of disease being treated.

The terms "treat," "treating," "treatment," and grammatical variations thereof as used herein, include partially or completely delaying, alleviating, mitigating or reducing the intensity of one or more attendant symptoms of a cancer or condition and/or alleviating, mitigating or impeding one or more causes of a cancer. Treatments according to the invention may be applied preventively, prophylactically, palliatively or remedially. Prophylactic treatments are administered to a subject prior to onset (e.g., before obvious signs of an infection), during early onset (e.g., upon initial signs and symptoms of an infection), after an established development of an infection, or during chronic infection. Prophylactic administration can occur for several minutes to months prior to the manifestation of an infection.

As used herein, the term "preventing" a disorder or unwanted physiological event in a subject refers specifically to the prevention of the occurrence of symptoms and/or their underlying cause, wherein the subject may or may not exhibit heightened susceptibility to the disorder or event.

Antibodies and Compositions

In some aspects, disclosed herein is a recombinant antibody, said antibody comprising a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein CDRL3 comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to

```
                                    (SEQ ID NO: 13)
    MQPLQLPDT, (SEQ ID NO: 25)
    QQSYNVPT, (SEQ ID NO: 39)
    HQSSSLPFT, (SEQ ID NO: 49)
    QHFYSSPPT, (SEQ ID NO: 88)
    CLYAGSYSWV,
    or (SEQ ID NO: 101)
    QVWDSSSEHVV;
``` and/or

CDRH3 comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to

```
                                    (SEQ ID NO: 104)
    ARVAPPGVVNNKWFDI, (SEQ ID NO: 110)
    ARSEKRVTMTRKIKGRWFGP, (SEQ ID NO: 1817)
    CAAGLWSGDLSRPRYSDSW, (SEQ ID NO: 1818)
    CAKGLTTESRLEFW, (SEQ ID NO: 1819)
    CVSSWGPESPYYFDYW,
    or (SEQ ID NO: 1820)
    CAREYCTGGDCHFFLDYW.
```

In some aspects, disclosed herein is a recombinant antibody, said antibody comprising a light chain variable region (VL) that comprises a light chain complementarity determining region (CDRL) 1, CDRL2, and CDRL3 or a heavy chain variable region (VH) that comprises a heavy chain complementarity determining region (CDRH) 1, CDRH2, and CDRH3, wherein CDRL3 comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to

```
                              (SEQ ID NO: 13)
    MQPLQLPDT, (SEQ ID NO: 25)
    QQSYNVPT, (SEQ ID NO: 39)
    HQSSSLPFT, (SEQ ID NO: 49)
    QHFYSSPPT, (SEQ ID NO: 88)
    CLYAGSYSWV,
    or (SEQ ID NO: 101)
    QVWDSSSEHVV;
``` and/or

CDRH3 comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to

```
                             (SEQ ID NO: 104)
    ARVAPPGVVNNKWFDI, (SEQ ID NO: 110)
    ARSEKRVTMTRKIKGRWFGP, (SEQ ID NO: 1817)
    CAAGLWSGDLSRPRYSDSW, (SEQ ID NO: 1818)
    CAKGLTTESRLEFW, (SEQ ID NO: 1819)
    CVSSWGPESPYYFDYW,
    or (SEQ ID NO: 1820)
    CAREYCTGGDCHFFLDYW.
```

In some embodiments, the CDRL3 comprises at least one amino acid substitution when compared to SEQ ID NO: 13, 25, 39, 49, 88, or 101. In some embodiments, the CDRL3 comprises at least 1, 2, 3, 4, 5, or 6 substitutions when compared to SEQ ID NO: 13. In some embodiments, the CDRL3 comprises at least 1, 2, 3, 4, 5, or 6 amino acid substitutions when compared to SEQ ID NO: 25. In some embodiments, the CDRL3 comprises at least 1, 2, 3, 4, 5, or 6 amino acid substitutions when compared to SEQ ID NO: 39. In some embodiments, the CDRL3 comprises at least 1, 2, 3, 4, 5, or 6 amino acid substitutions when compared to SEQ ID NO: 49. In some embodiments, the CDRL3 comprises at least 1, 2, 3, 4, 5, or 6 amino acid substitutions when compared to SEQ ID NO: 88. In some embodiments, the CDRL3 comprises at least 1, 2, 3, 4, 5, or 6 amino acid substitutions when compared to 101.

In some embodiments, the at least one amino acid substitution is selected from the group consisting of a) at position 1 when compared to SEQ ID NO: 13, wherein the substituting amino acid residue is K;

b) at position 3 when compared to SEQ ID NO: 13, wherein the substituting amino acid residue is selected from the group consisting of A, T, G, V, D, Y, and F;

c) at position 6 when compared to SEQ ID NO: 13, wherein the substituting amino acid residue is selected from the group consisting of H, S, T, P, I, V, P, R, and V;

d) at position 9 when compared to SEQ ID NO: 13, wherein the substituting amino acid residue is selected from the group consisting of Y, L, H, P, I, G, C, J, R, and Q;

e) at position 5 when compared to SEQ ID NO: 25, wherein the substituting amino acid residue is selected from the group consisting of T, P, Y, R, I, G, and S;

f) at position 6 when compared to SEQ ID NO: 25, wherein the substituting amino acid residue is selected from the group consisting of A, T, and P;

g) at position 7 when compared to SEQ ID NO: 25, wherein the substituting amino acid residue is selected from the group consisting of W, A, R, G and L;

h) at position 3 when compared to SEQ ID NO: 39, wherein the substituting amino acid residue is T;

i) at position 4 when compared to SEQ ID NO: 39, wherein the substituting amino acid residue is selected from the group consisting of R, G, T, Y, A, and K;

j) at position 6 when compared to SEQ ID NO: 39, wherein the substituting amino acid residue is F;

k) at position 7 when compared to SEQ ID NO: 39, wherein the substituting amino acid residue is selected from the group consisting of G, Q, L, and S.

l) at position 8 when compared to SEQ ID NO: 39, wherein the substituting amino acid residue is selected from the group consisting of G, Q, Y, W, H, and L;

m) at position 9 when compared to SEQ ID NO: 39, wherein the substituting amino acid residue is selected from the group consisting of A, P, and S.

n) at position 3 when compared to SEQ ID NO: 49, wherein the substituting amino acid residue is L;

o) at position 5 when compared to SEQ ID NO: 49, wherein the substituting amino acid residue is T;

p) at position 6 when compared to SEQ ID NO: 49, wherein the substituting amino acid residue is selected from the group consisting of N, D, and K;

q) at position 2 when compared to SEQ ID NO: 88, wherein the substituting amino acid residue is selected from the group consisting of S, P and T;

r) at position 6 when compared to SEQ ID NO: 88, wherein the substituting amino acid residue is R;

s) at position 8 when compared to SEQ ID NO: 88, wherein the substituting amino acid residue is selected from the group consisting of N, W, and T;

t) at position 9 when compared to SEQ ID NO: 88, wherein the substituting amino acid residue is A;

u) at position 2 when compared to SEQ ID NO: 101, wherein the substituting amino acid residue is selected from the group consisting of M, A, and L;

v) at position 3 when compared to SEQ ID NO: 101, wherein the substituting amino acid residue is C;

w) at position 4 when compared to SEQ ID NO: 101, wherein the substituting amino acid residue is Y;

x) at position 7 when compared to SEQ ID NO: 101, wherein the substituting amino acid residue is N; and y) at position 8 when compared to SEQ ID NO: 101, wherein the substituting amino acid residue is D.

Accordingly, in some embodiments, the recombinant antibody of any preceding aspect comprises a CDRL3 comprising an amino acid sequence selected from the group consisting of SEQ ID NOs: 1-12, 14-24, 26-38, 40-48, 50-87, and 89-100. In some embodiments, the recombinant antibody of any preceding aspect comprises a CDRL3 comprising an amino acid sequence selected from the group consisting of SEQ ID NOs: 1-12, 14-24, 26-38, 40-48, 50-51, and 89-100.

Accordingly, in some embodiments, the recombinant antibody disclosed herein comprises a VL that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to SEQ ID NOs: 119-1693. In some embodiments, the VL comprises an amino acid sequence selected from the group consisting of SEQ ID NOS: 119-1693.

In some embodiments, the recombinant antibody of any preceding aspect comprises a CDRL3 that comprises an amino acid sequence selected from SEQ ID NOs: 13, 25, 39, 49, 88, 101, and 1883-1888. In some embodiments, the CDRL3 comprises an amino acid sequence of SEQ ID NO: 13. In some embodiments, the CDRL3 comprises an amino acid sequence of SEQ ID NO: 25. In some embodiments, the CDRL3 comprises an amino acid sequence of SEQ ID NO: 39. In some embodiments, the CDRL3 comprises an amino acid sequence of SEQ ID NO: 49. In some embodiments, the CDRL3 comprises an amino acid sequence of SEQ ID NO: 88. In some embodiments, the CDRL3 comprises an amino acid sequence of SEQ ID NO: 101. In some embodiments, the CDRL3 comprises an amino acid sequence of SEQ ID NO: 1883. In some embodiments, the CDRL3 comprises an amino acid sequence of SEQ ID NO: 1884. In some embodiments, the CDRL3 comprises an amino acid sequence of SEQ ID NO: 1885. In some embodiments, the CDRL3 comprises an amino acid sequence of SEQ ID NO: 1886. In some embodiments, the CDRL3 comprises an amino acid sequence of SEQ ID NO: 1887. In some embodiments, the CDRL3 comprises an amino acid sequence of SEQ ID NO: 1888.

In some embodiments, the recombinant antibody of any preceding aspect comprises a CDRL1 that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) selected from SEQ ID NOs: 13120-13125. In some embodiments, the recombinant antibody of any preceding aspect comprises a CDRL1 that comprises an amino acid sequence selected from SEQ ID NOs: 13120-13125. In some embodiments, the CDRL1 comprises an amino acid sequence of SEQ ID NO: 13120. In some embodiments, the CDRL1 comprises an amino acid sequence of SEQ ID NO: 13121. In some embodiments, the CDRL1 comprises an amino acid sequence of SEQ ID NO: 13122. In some embodiments, the CDRL1 comprises an amino acid sequence of SEQ ID NO: 13123. In some embodiments, the CDRL1 comprises an amino acid sequence of SEQ ID NO: 13124. In some embodiments, the CDRL1 comprises an amino acid sequence of SEQ ID NO: 13125.

In some embodiments, the recombinant antibody of any preceding aspect comprises a CDRL2 that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) selected from SEQ ID NOs: 13126-13131. In some embodiments, the recombinant antibody of any preceding aspect comprises a CDRL2 that comprises an amino acid sequence selected from SEQ ID NOs: 13126-13131. In some embodiments, the CDRL2 comprises an amino acid sequence of SEQ ID NO: 13126. In some embodiments, the CDRL2 comprises an amino acid sequence of SEQ ID NO: 13127. In some embodiments, the CDRL2 comprises an amino acid sequence of SEQ ID NO: 13128. In some embodiments, the CDRL2 comprises an amino acid sequence of SEQ ID NO: 13129. In some embodiments, the CDRL2 comprises an amino acid sequence of SEQ ID NO: 13130. In some embodiments, the CDRL2 comprises an amino acid sequence of SEQ ID NO: 13131.

Accordingly, in some embodiments, the recombinant antibody disclosed herein comprises a VL that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to SEQ ID NOs: 119, 227, 242, 351, 1399, 1406, and 1899-1904. In some embodiments, the VL comprises an amino acid sequence selected from the group consisting of SEQ ID NOs: SEQ ID NOs: 119, 227, 242, 351, 1399, 1406, and 1899-1904.

In some embodiments, the recombinant antibody of any preceding aspect comprises a CDRH3, wherein the CDRH3 comprises at least one amino acid substitution when compared to SEQ ID NO: 104, 110, 1817, 1818, 1819, or 1820. In some embodiments, the CDRH3 comprises at least 1, 2, 3, 4, 5, or 6 substitutions when compared to SEQ ID NO: 104. In some embodiments, the CDRH3 comprises at least 1, 2, 3, 4, 5, or 6 amino acid substitutions when compared to SEQ ID NO: 110. In some embodiments, the CDRH3 comprises at least 1, 2, 3, 4, 5, or 6 amino acid substitutions when compared to SEQ ID NO: 1817. In some embodiments, the CDRH3 comprises at least 1, 2, 3, 4, 5, or 6 amino acid substitutions when compared to SEQ ID NO: 1818. In some embodiments, the CDRH3 comprises at least 1, 2, 3, 4, 5, or 6 amino acid substitutions when compared to SEQ ID NO: 1819. In some embodiments, the CDRH3 comprises at least 1, 2, 3, 4, 5, or 6 amino acid substitutions when compared to 1820.

In some embodiments, a CDR sequence (for example CDRL1, CDRL2, CDRL3, CDRH1, CDRH2, or CDRH3) comprises one amino acid mutation, two amino acid mutations, three amino acid mutations, four amino acid mutations, five amino acid mutations, etc. when compared to a CDR sequence as disclosed herein.

In some embodiments, the recombinant antibody is a monoclonal antibody. In some embodiments, the recombinant antibody is an isolated antibody. In some embodiments, the recombinant antibody is an antibody or antigen binding fragment thereof. In some embodiments, combinations of antibodies or antigen binding fragments thereof disclosed herein are used for treating HIV infection, HCV infection, or HIV/HCV co-infection.

In some embodiments, the at least one amino acid substitution is selected from the group consisting of a) at position 3 when compared to SEQ ID NO: 104, wherein the substituting amino acid residue is G or I;

b) at position 4 when compared to SEQ ID NO: 104, wherein the substituting amino acid residue is S, T, or P;

c) at position 9 when compared to SEQ ID NO: 104, wherein the substituting amino acid residue is A;

d) at position 11 when compared to SEQ ID NO: 104, wherein the substituting amino acid residue is K or H;

e) at position 14 when compared to SEQ ID NO: 104, wherein the substituting amino acid residue is L;

f) at position 16 when compared to SEQ ID NO: 104, wherein the substituting amino acid residue is L or T;

g) at position 1 when compared to SEQ ID NO: 110, wherein the substituting amino acid residue is T or S;

h) at position 5 when compared to SEQ ID NO: 110, wherein the substituting amino acid residue is N or P;

i) at position 7 when compared to SEQ ID NO: 110, wherein the substituting amino acid residue is I, N, K, or L;

j) at position 9 when compared to SEQ ID NO: 110, wherein the substituting amino acid residue is L or T;

k) at position 10 when compared to SEQ ID NO: 110, wherein the substituting amino acid residue is A or V;

l) at position 11 when compared to SEQ ID NO: 110, wherein the substituting amino acid residue is L.

m) at position 17 when compared to SEQ ID NO: 110, wherein the substituting amino acid residue is S;

n) at position 19 when compared to SEQ ID NO: 110, wherein the substituting amino acid residue is D; and o) at position 20 when compared to SEQ ID NO: 110, wherein the substituting amino acid residue is S.

Accordingly, in some embodiments, the recombinant antibody of any preceding aspect comprises a CDRH3 comprising an amino acid sequence selected from the group consisting of SEQ ID NOs: 102-103, 105-109, and 111-118.

Accordingly, in some embodiments, the recombinant antibody disclosed herein comprises a VH that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to SEQ ID NOs: 1694-1756. In some embodiments, the VL comprises an amino acid sequence selected from the group consisting of SEQ ID NOs: 1694-1756.

In some embodiments, the recombinant antibody of any preceding aspect comprises a CDRH3 that comprises an amino acid sequence selected from SEQ ID NOs: 104, 110, and 1817-1822. In some embodiments, the CDRH3 comprises an amino acid sequence of SEQ ID NO: 104. In some embodiments, the CDRH3 comprises an amino acid sequence of SEQ ID NO: 110. In some embodiments, the CDRH3 comprises an amino acid sequence of SEQ ID NO: 1817. In some embodiments, the CDRH3 comprises an amino acid sequence of SEQ ID NO: 1818. In some embodiments, the CDRH3 comprises an amino acid sequence of SEQ ID NO: 1819 In some embodiments, the CDRH3 comprises an amino acid sequence of SEQ ID NO: 1820. In some embodiments, the CDRH3 comprises an amino acid sequence of SEQ ID NO: 1821. In some embodiments, the CDRH3 comprises an amino acid sequence of SEQ ID NO: 1822.

In some embodiments, the recombinant antibody of any preceding aspect comprises a CDRH1 that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) selected from SEQ ID NOs: 13102-13107. In some embodiments, the recombinant antibody of any preceding aspect comprises a CDRH1 that comprises an amino acid sequence selected from SEQ ID NOs: 13102-13107. In some embodiments, the CDRH1 comprises an amino acid sequence of SEQ ID NO: 13102. In some embodiments, the CDRH1 comprises an amino acid sequence of SEQ ID NO: 13103. In some embodiments, the CDRH1 comprises an amino acid sequence of SEQ ID NO: 13104. In some embodiments, the CDRH1 comprises an amino acid sequence of SEQ ID NO: 13105. In some embodiments, the CDRH1 comprises an amino acid sequence of SEQ ID NO: 13106. In some embodiments, the CDRH1 comprises an amino acid sequence of SEQ ID NO: 13107.

In some embodiments, the recombinant antibody of any preceding aspect comprises a CDRH2 that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) selected from SEQ ID NOs: 13108-13113. In some embodiments, the recombinant antibody of any preceding aspect comprises a CDRH2 that comprises an amino acid sequence selected from SEQ ID NOs: 13108-13113. In some embodiments, the CDRH2 comprises an amino acid sequence of SEQ ID NO: 13108. In some embodiments, the CDRH2 comprises an amino acid sequence of SEQ ID NO: 13109. In some embodiments, the CDRH2 comprises an amino acid sequence of SEQ ID NO: 13110. In some embodiments, the CDRH2 comprises an amino acid sequence of SEQ ID NO: 13111. In some embodiments, the CDRH2 comprises an amino acid sequence of SEQ ID NO: 13112. In some embodiments, the CDRH2 comprises an amino acid sequence of SEQ ID NO: 13113.

In some embodiments, the CDRH3 comprises an amino acid sequence selected from the group consisting of SEQ ID NOs: 13138-13143, 13148-13150, and 13153-13155.

In some embodiments, the CDRL3 comprises an amino acid sequence selected from the group consisting of SEQ ID NOs: 13151 and 13152.

In some embodiments, the recombinant antibody disclosed herein comprises an amino acid sequence selected from SEQ ID NOs: 13144, 13145, 13146, and 13147.

Accordingly, in some embodiments, the recombinant antibody disclosed herein comprises a VH that comprises an amino acid sequence at least 60% (for example, at least 60%, at least 65%, at least 70%, at least 75%, at least 80%, at least 85%, at least 90%, at least 95%, at least 96%, at least 97%, at least 98%, at least 99%) identical to SEQ ID NOs: 1895-1898, 1694, and 1718. In some embodiments, the VH comprises an amino acid sequence selected from the group consisting of SEQ ID NOs: SEQ ID NOs: 1895-1898, 1694, and 1718.

In some embodiments, disclosed herein is a recombinant antibody that is selected from the group consisting of a) a recombinant antibody comprising the CDRL3 of SEQ ID NO: 88 or 1887 and the CDRH3 of SEQ ID NO: 104 or 1821;

b) a recombinant antibody comprising the CDRL3 of SEQ ID NO: 101 or 1888 and the CDRH3 of SEQ ID NO: 110 or 1822;

c) a recombinant antibody comprising the CDRL3 of SEQ ID NO: 13 or 1883 and the CDRH3 of SEQ ID NO: 1817;

d) a recombinant antibody comprising the CDRL3 of SEQ ID NO: 25 or 1884 and the CDRH3 of SEQ ID NO: 1818;

e) a recombinant antibody comprising the CDRL3 of SEQ ID NO: 39 or 1885 and the CDRH3 of SEQ ID NO: 1819; and f) a recombinant antibody comprising the CDRL3 of SEQ ID NO: 49 or 1886 and the CDRH3 of SEQ ID NO: 1820.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13102,
CDRH2 is SEQ ID NO: 13108,
CDRH3 is SEQ ID NO: 1817,
CDRL1 is SEQ ID NO: 13120,
CDRL2 is SEQ ID NO: 13126, and
CDRL3 is SEQ ID NO: 13 or 1883.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13103,
CDRH2 is SEQ ID NO: 13109,
CDRH3 is SEQ ID NO: 1818,
CDRL1 is SEQ ID NO: 13121,
CDRL2 is SEQ ID NO: 13127, and
CDRL3 is SEQ ID NO: 25 or 1884.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13104,
CDRH2 is SEQ ID NO: 13110,
CDRH3 is SEQ ID NO: 1819,
CDRL1 is SEQ ID NO: 13122,
CDRL2 is SEQ ID NO: 13128, and
CDRL3 is SEQ ID NO: 39 or 1885.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13105,
CDRH2 is SEQ ID NO: 13111,
CDRH3 is SEQ ID NO: 1820,
CDRL1 is SEQ ID NO: 13123,
CDRL2 is SEQ ID NO: 13129, and
CDRL3 is SEQ ID NO: 49 or 1886.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13106,
CDRH2 is SEQ ID NO: 13112,
CDRH3 is SEQ ID NO: 104 or 1821,
CDRL1 is SEQ ID NO: 13124,
CDRL2 is SEQ ID NO: 13130, and
CDRL3 is SEQ ID NO: 88 or 1887.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13107,
CDRH2 is SEQ ID NO: 13113,
CDRH3 is SEQ ID NO: 110 or 1822,
CDRL1 is SEQ ID NO: 13125,
CDRL2 is SEQ ID NO: 13131, and
CDRL3 is SEQ ID NO: 101 or 1888.

In some embodiments, the recombinant antibody of any preceding aspect further comprises a framework region (FWR) 1, FWR2, FWR3, and/or FWR4.

In some embodiments, the recombinant antibody of any preceding aspect, wherein the FWRH1 is encoded by a polynucleotide comprising a nucleic acid sequence selected from SEQ ID NOs: 3881-4334.

In some embodiments, the recombinant antibody of any preceding aspect, wherein the FWRH2 is encoded by a polynucleotide comprising a nucleic acid sequence selected from SEQ ID NOs: 4335-4793.

In some embodiments, the recombinant antibody of any preceding aspect, wherein the FWRH3 is encoded by a polynucleotide comprising a nucleic acid sequence selected from SEQ ID NOs: 4794-5346.

In some embodiments, the recombinant antibody of any preceding aspect, wherein the FWRH4 is encoded by a polynucleotide comprising a nucleic acid sequence selected from SEQ ID NOs: 5347-5576.

In some embodiments, the recombinant antibody of any preceding aspect, wherein the CDRH1 is encoded by a polynucleotide comprising a nucleic acid sequence selected from SEQ ID NOs: 5577-6052.

In some embodiments, the recombinant antibody of any preceding aspect, wherein the CDRH2 is encoded by a polynucleotide comprising a nucleic acid sequence selected from SEQ ID NOs: 6053-6533.

In some embodiments, the recombinant antibody of any preceding aspect, wherein the CDRH3 is encoded by a polynucleotide comprising a nucleic acid sequence selected from SEQ ID NOs: 6534-7770.

In some embodiments, the recombinant antibody of any preceding aspect, wherein the FWRL1 is encoded by a polynucleotide comprising a nucleic acid sequence selected from SEQ ID NOs: 9190-9645.

In some embodiments, the recombinant antibody of any preceding aspect, wherein the FWRL2 is encoded by a polynucleotide comprising a nucleic acid sequence selected from SEQ ID NOs: 9646-10150.

In some embodiments, the recombinant antibody of any preceding aspect, wherein the FWRL3 is encoded by a polynucleotide comprising a nucleic acid sequence selected from SEQ ID NOs: 10151-10734.

In some embodiments, the recombinant antibody of any preceding aspect, wherein the FWRL4 is encoded by a polynucleotide comprising a nucleic acid sequence selected from SEQ ID NOs: 10735-11022.

In some embodiments, the recombinant antibody of any preceding aspect, wherein the CDRL1 is encoded by a polynucleotide comprising a nucleic acid sequence selected from SEQ ID NOs: 11023-11522.

In some embodiments, the recombinant antibody of any preceding aspect, wherein the CDRL2 is encoded by a polynucleotide comprising a nucleic acid sequence selected from SEQ ID NOs: 11523-11766.

In some embodiments, the recombinant antibody of any preceding aspect, wherein the CDRL3 is encoded by a polynucleotide comprising a nucleic acid sequence selected from SEQ ID NOs: 11767-13101.

Figures 27, 28:
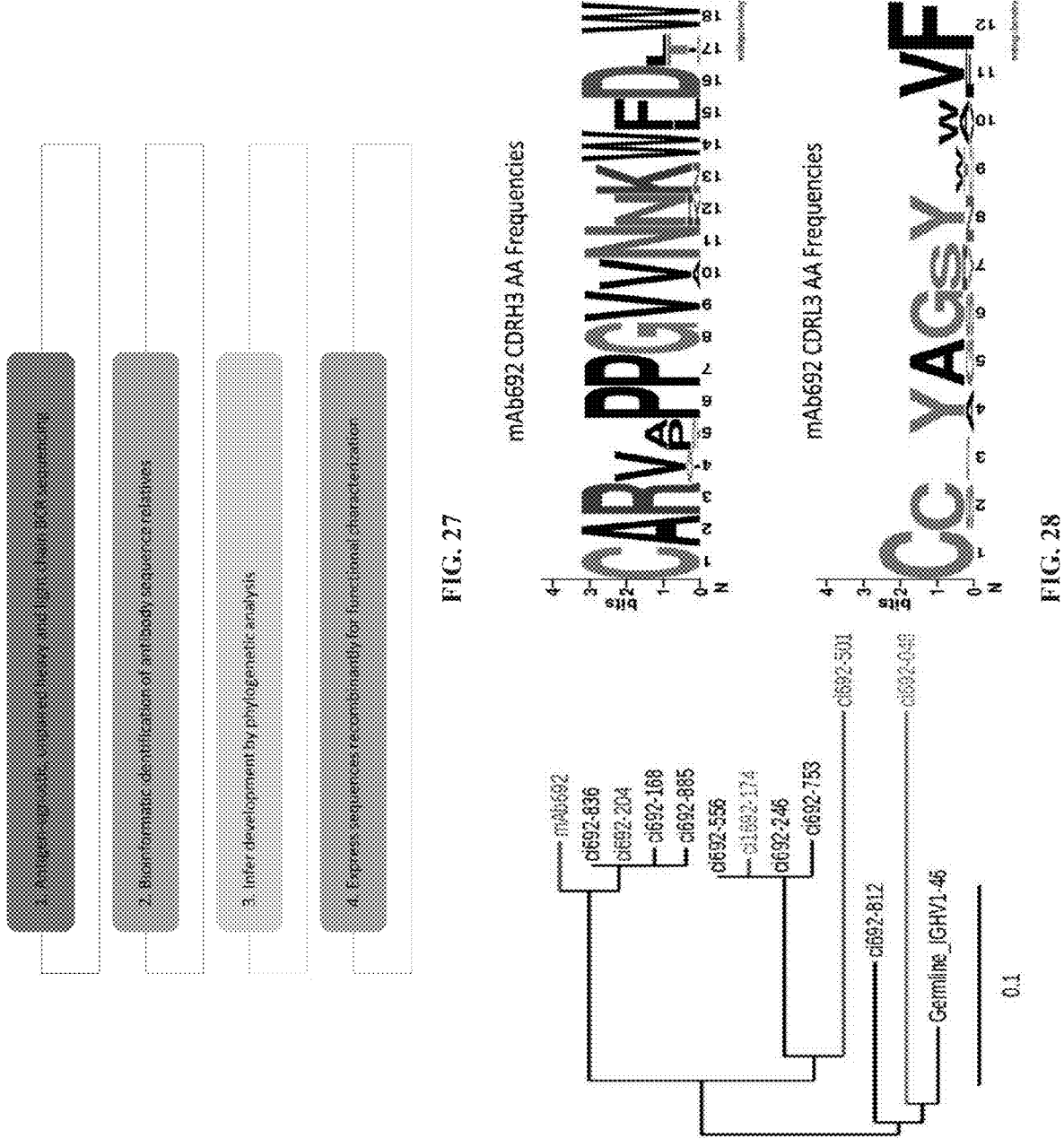
FIG. 27 shows the experimental workflow for identifying HIV/HCV mAb relative sequences.
FIG. 28 shows mAb692 development and sequence.
Figures 29A, 29B:
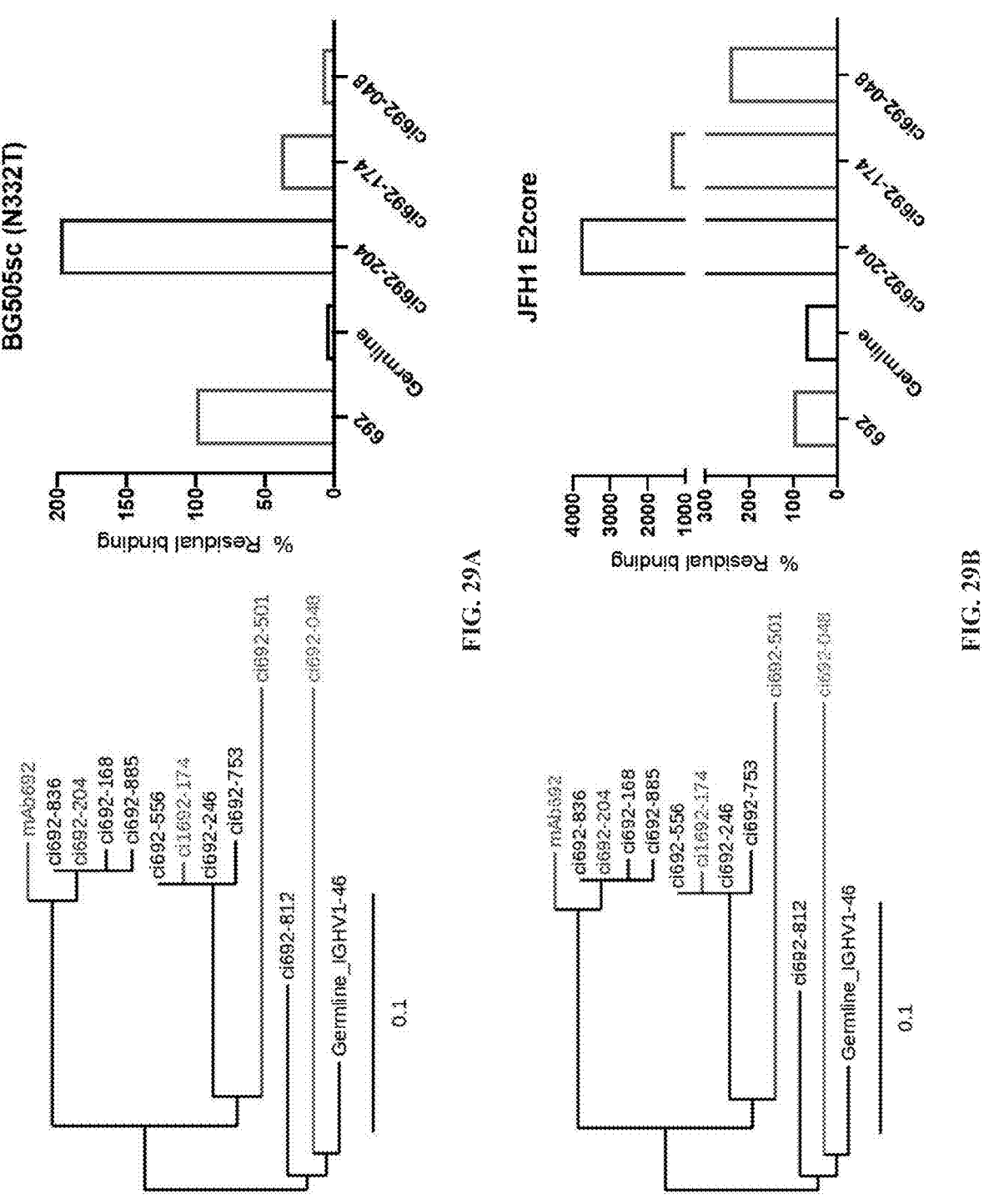
FIGS. 29A-29B shows that acquired mutations alter antigen specificity.
Figure 30:
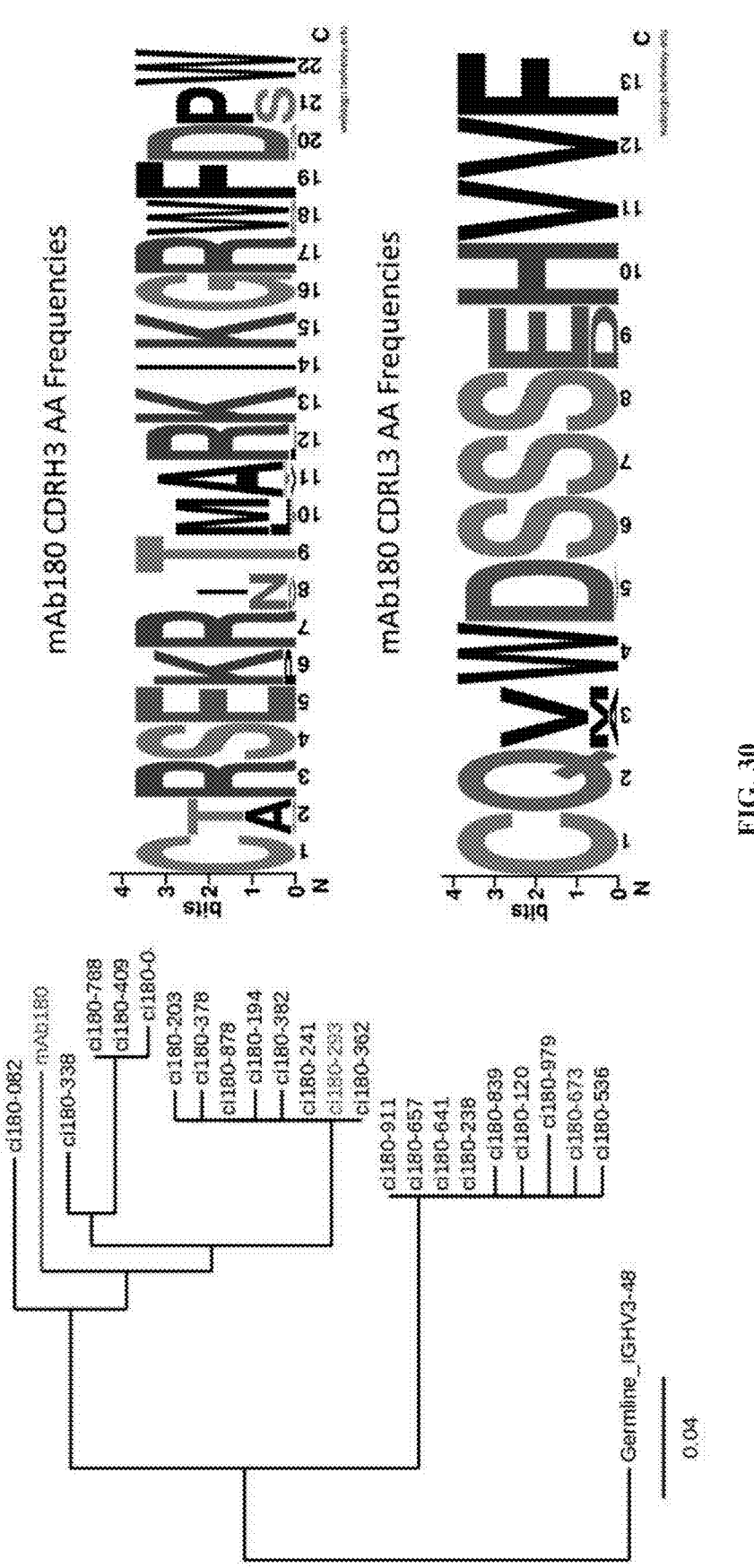
FIG. 30 shows mAb180 development and sequence.
Figure 31A:
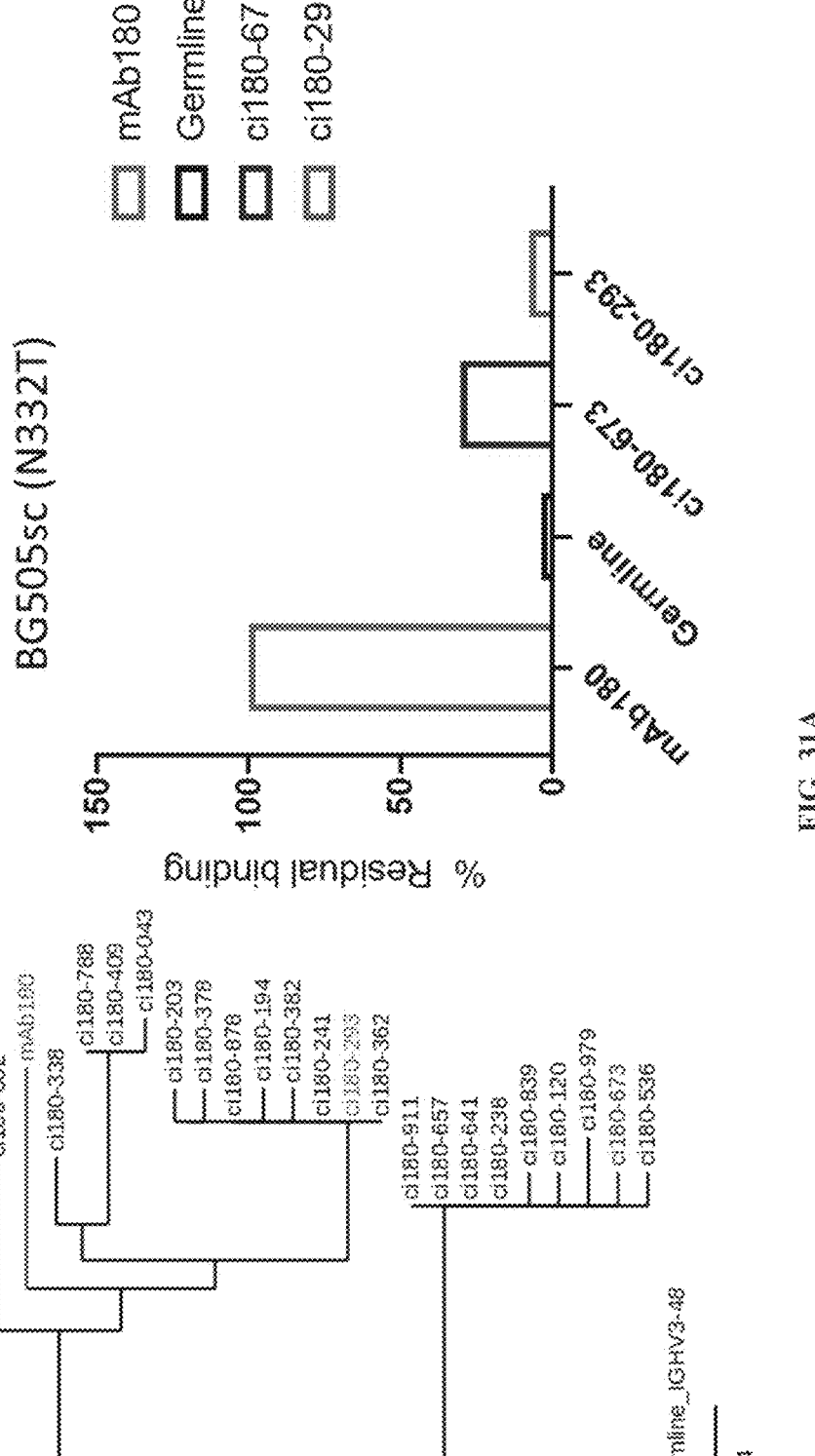
Figure 32:
FIG. 32 shows epidemiology of HIV and HCV mono- and co-infection and significance of the current study.
Figure 32:
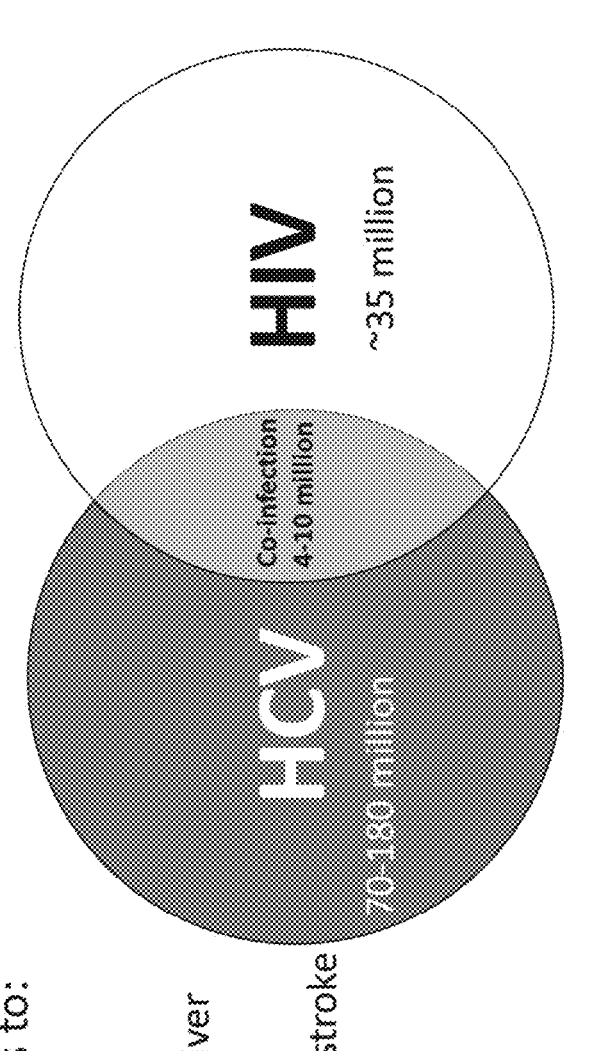
Figure 33A:
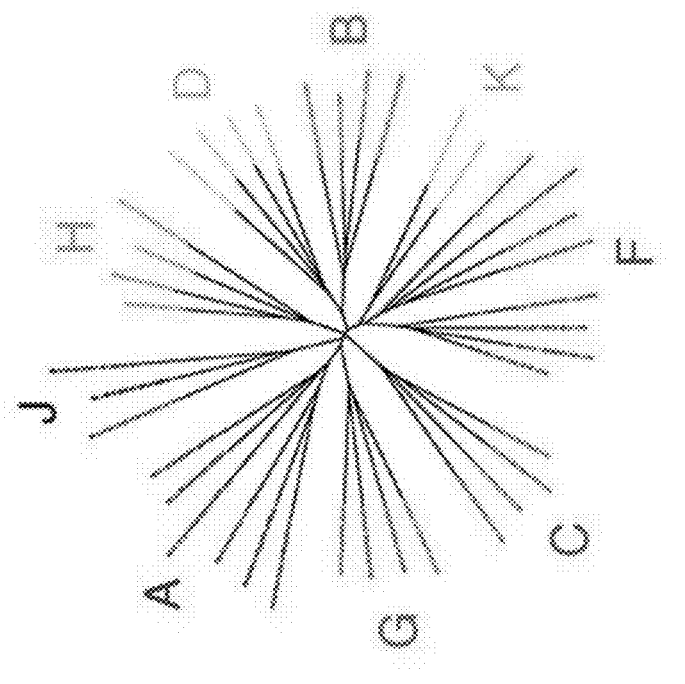
FIGS. 33A-33B show the diversity of HCV (FIG. 33A) and HIV (FIG. 33B) proteins, which renders the difficulties of vaccine development to treat these viruses.
Figure 33B:
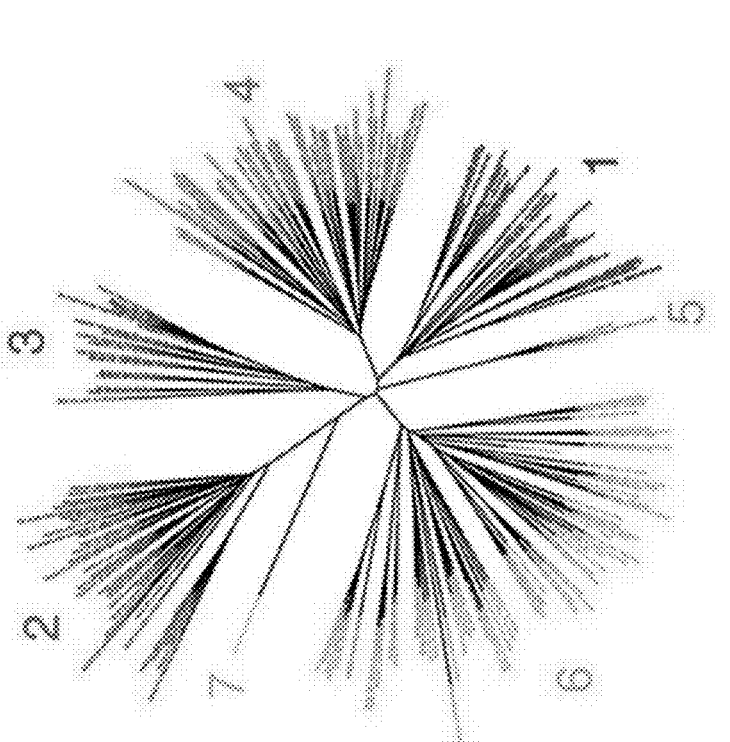
Figure 34:
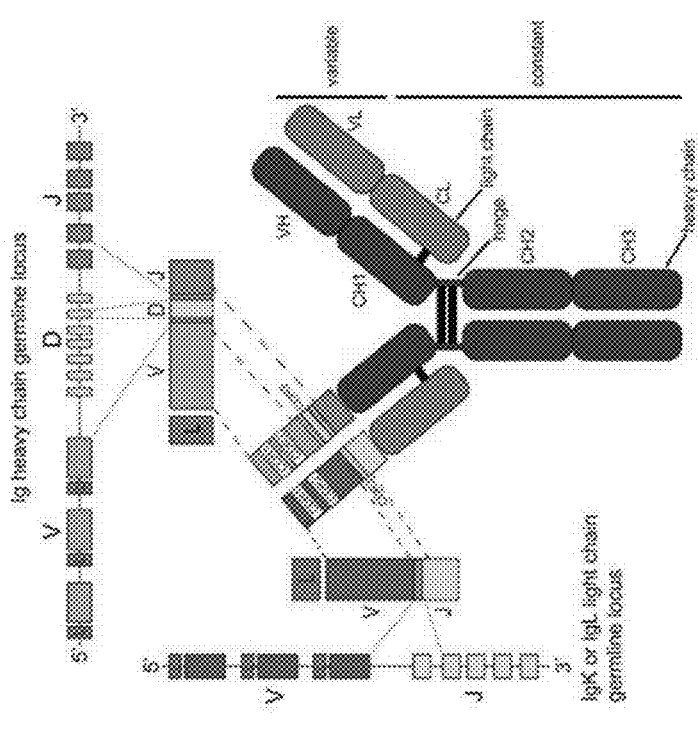
FIG. 34 depicts schematic representation of antibody structures.
Figure 35:
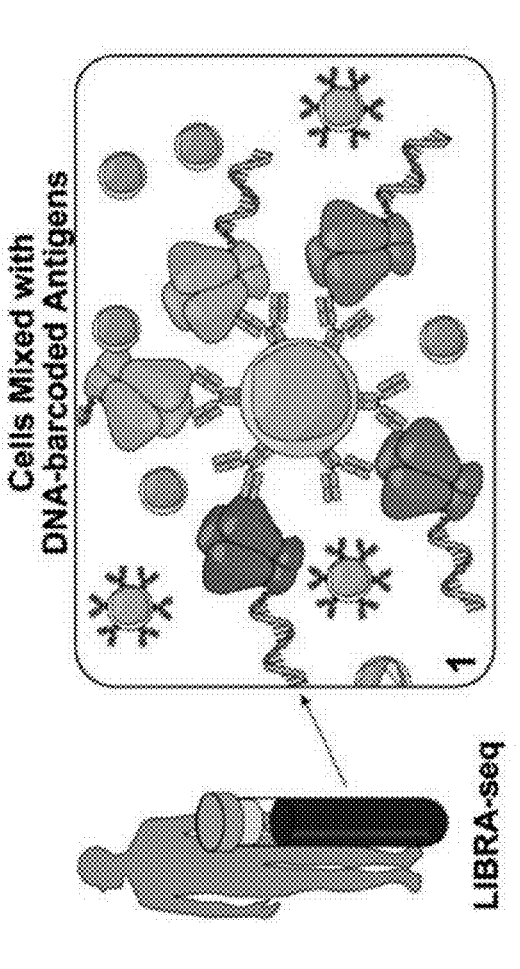
FIG. 35 shows LIBRA-seq: high throughput mapping of b cell receptor specificities.
Figure 35:
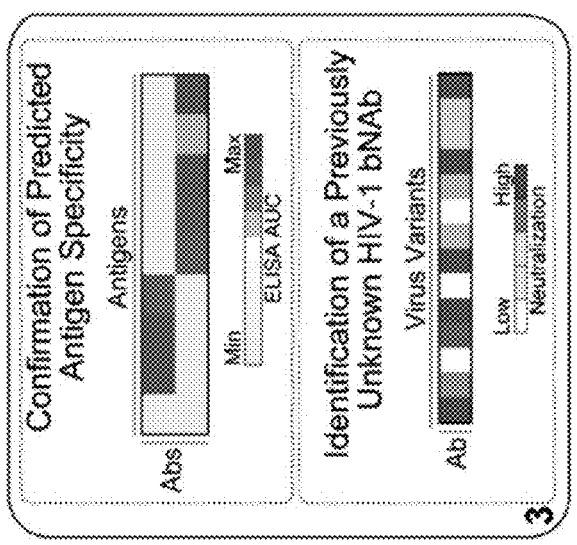
Figure 35:
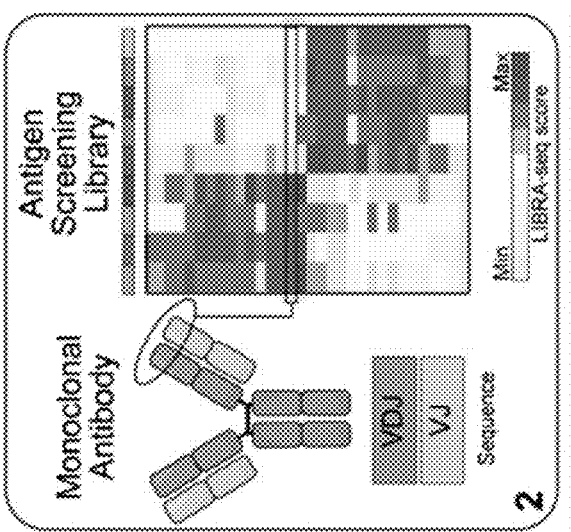
Figure 36A:
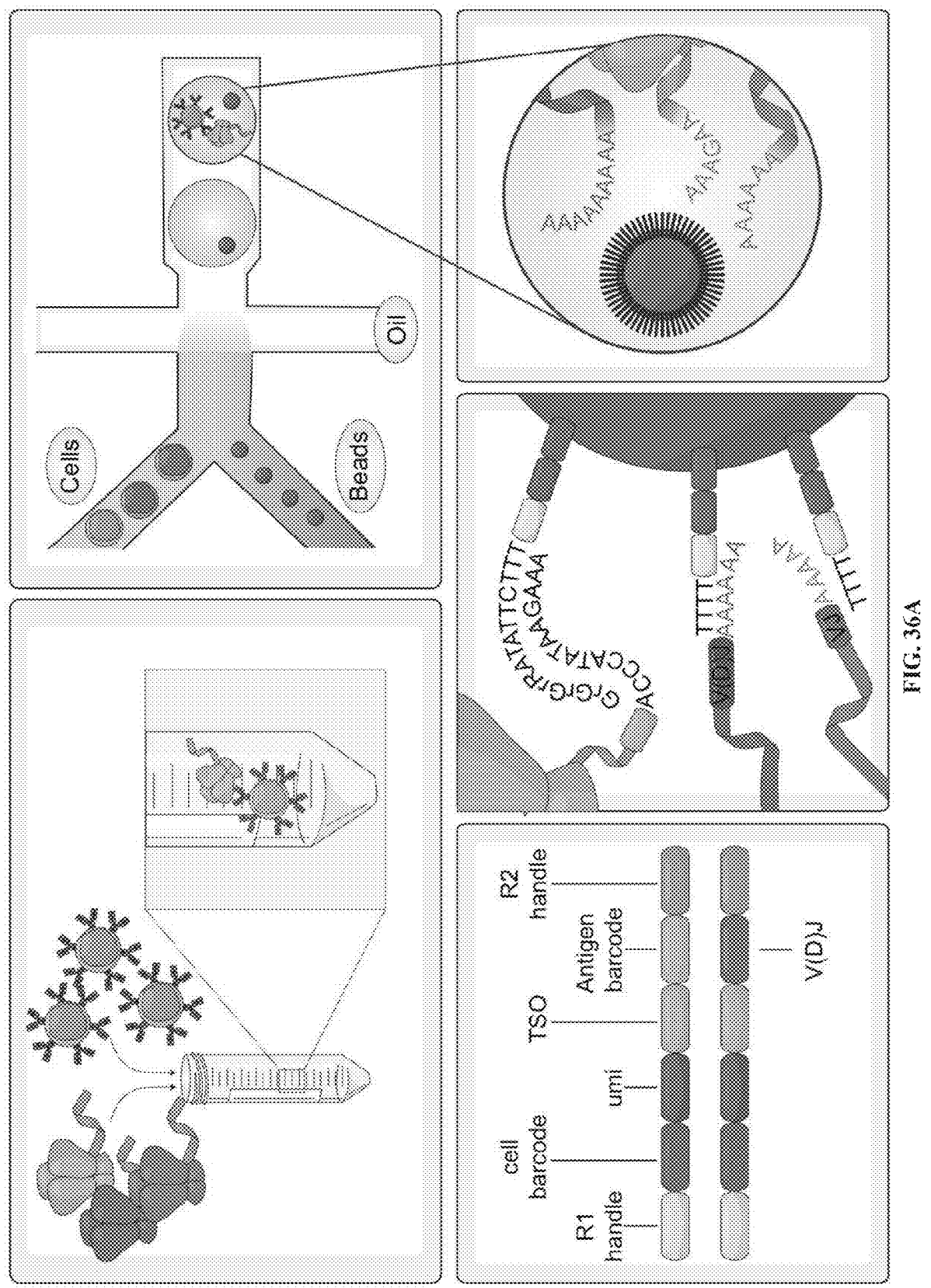
FIGS. 36A-36B shows Linking B cell Receptor sequence to Antigen Specificity by Sequencing (LIBRA-Seq).
Figure 36B:
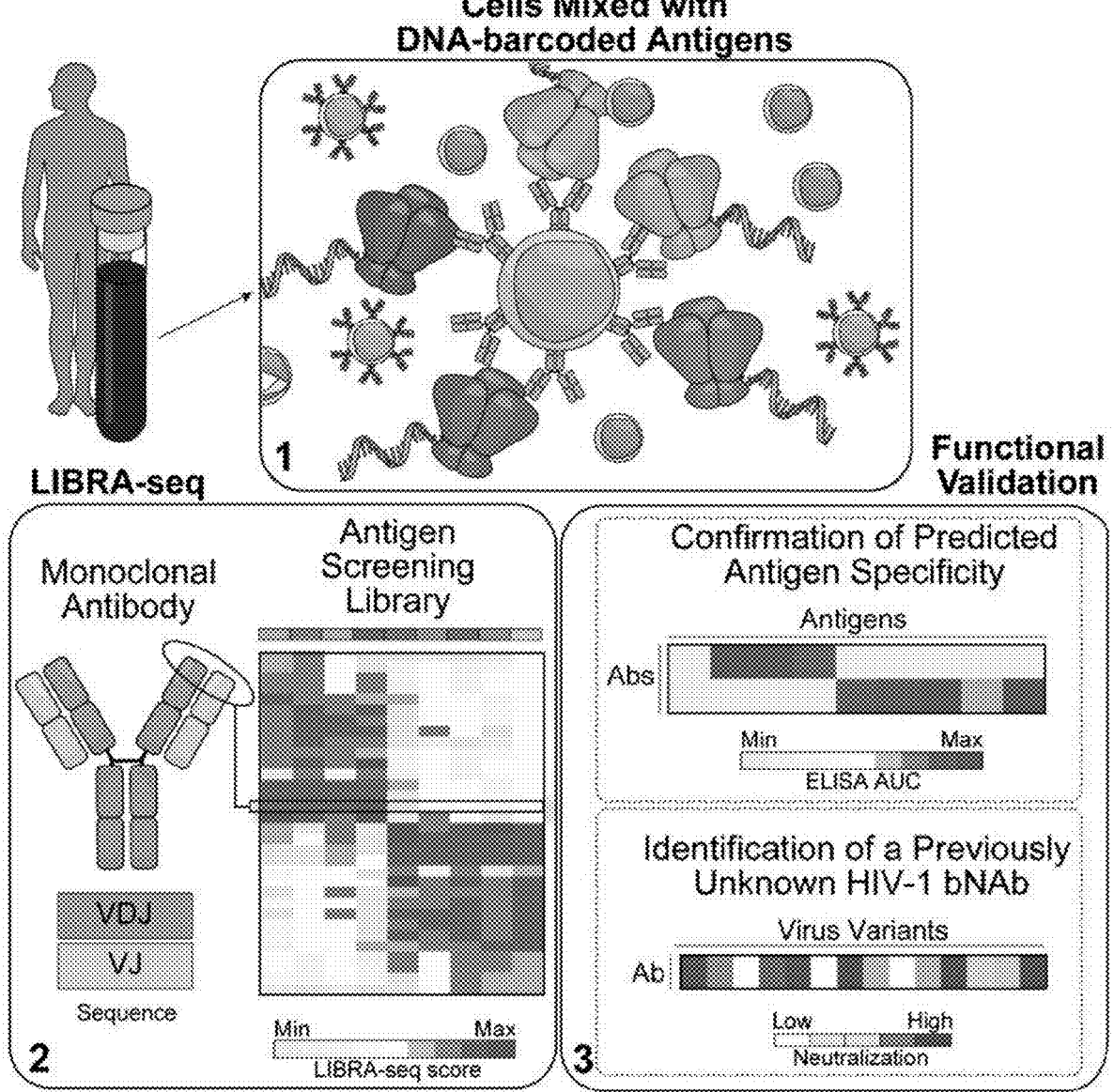
Figure 37:
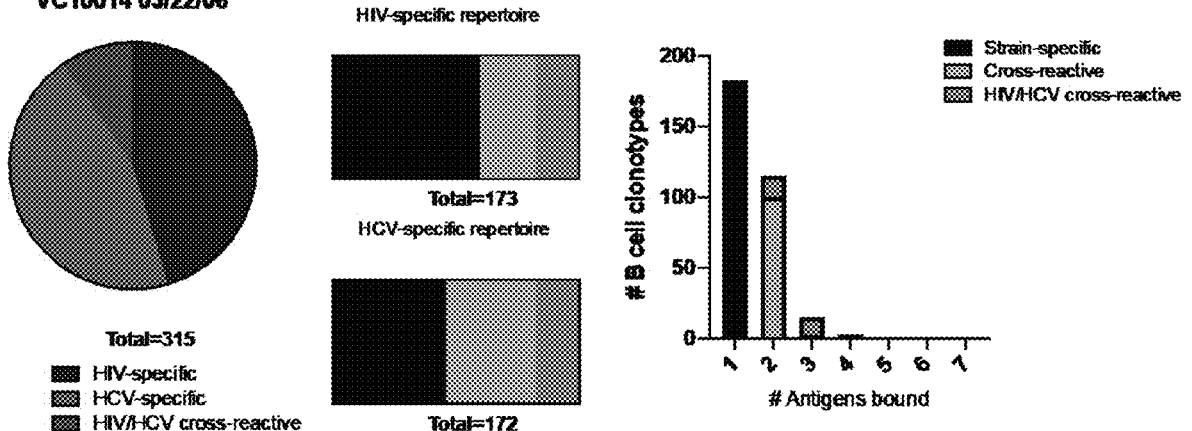
FIG. 37 shows that LIBRA-seq identifies virus-specific antibody specificities.
Figure 38:
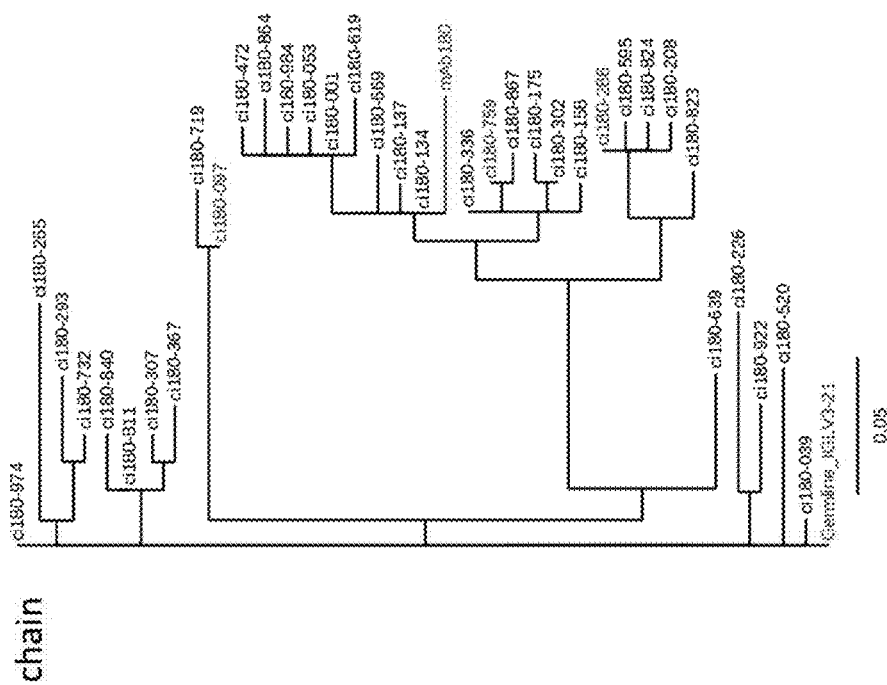
FIG. 38 shows mAb180 antibody development revealed by unpaired BCR sequencing.
Figure 38:
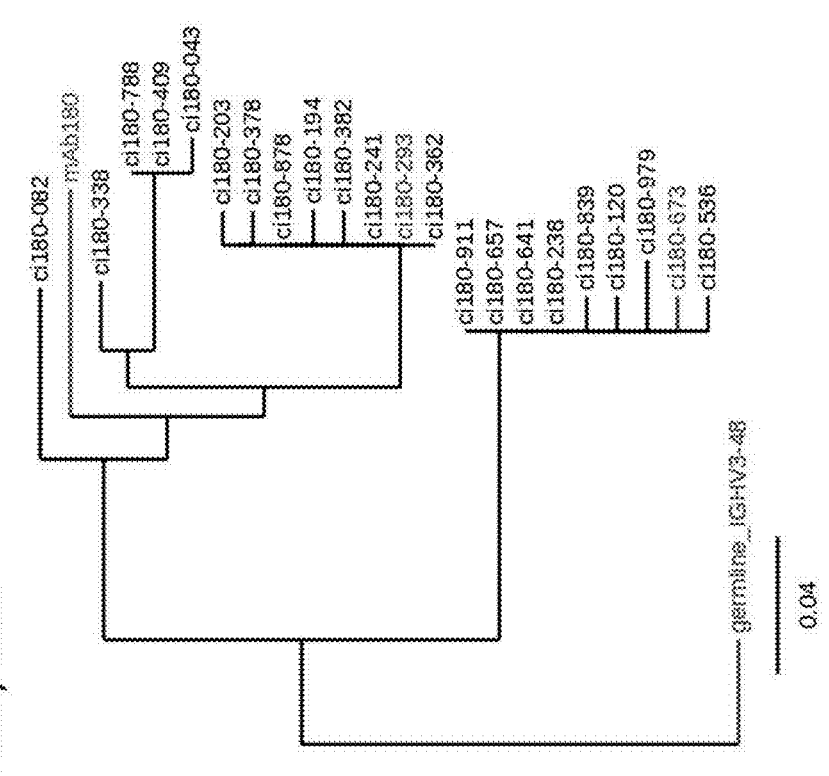
Figure 39:
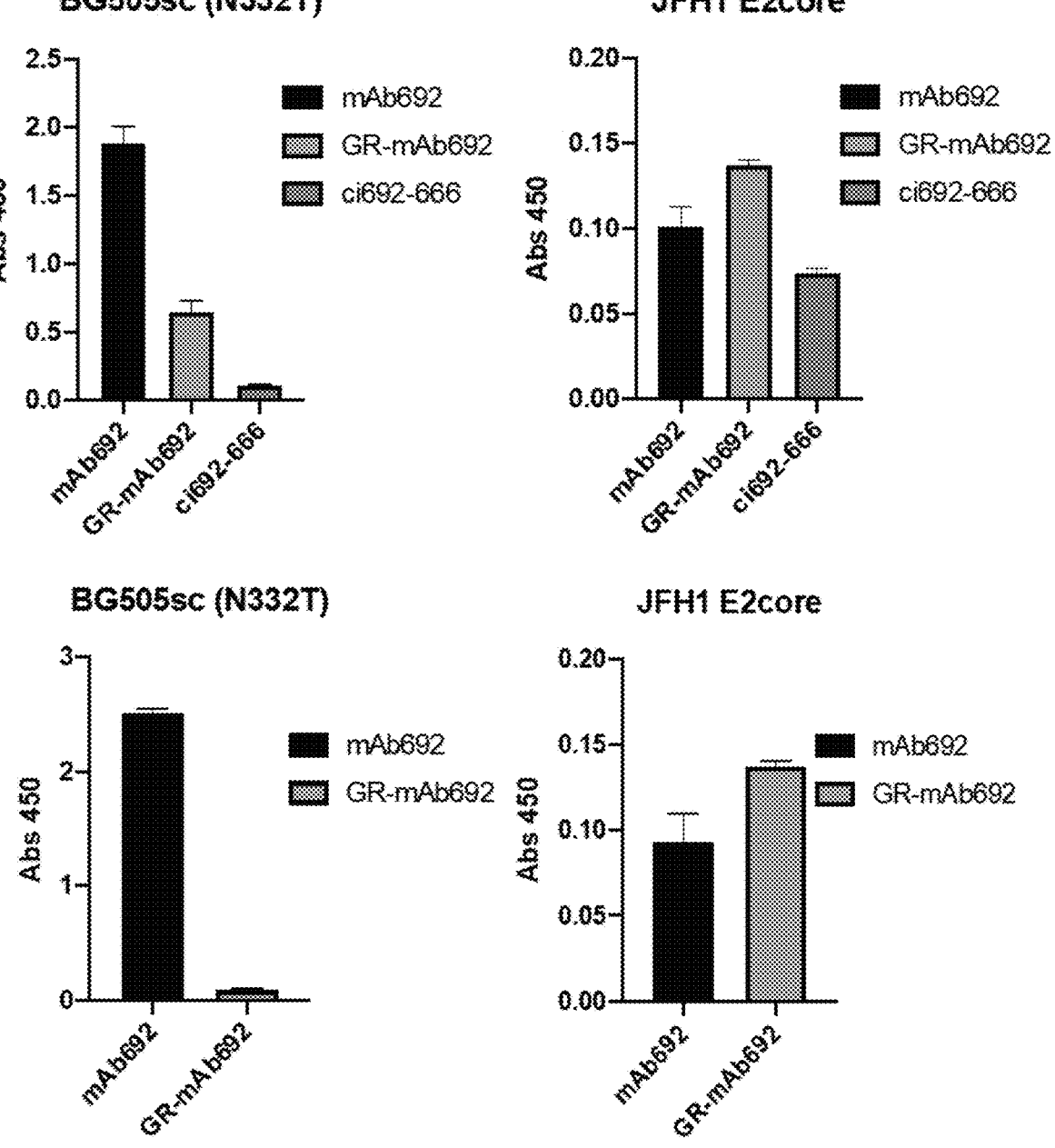
FIG. 39 depicts germline reverted mAb sequences showing inverted antigen specificities.
Figure 40:
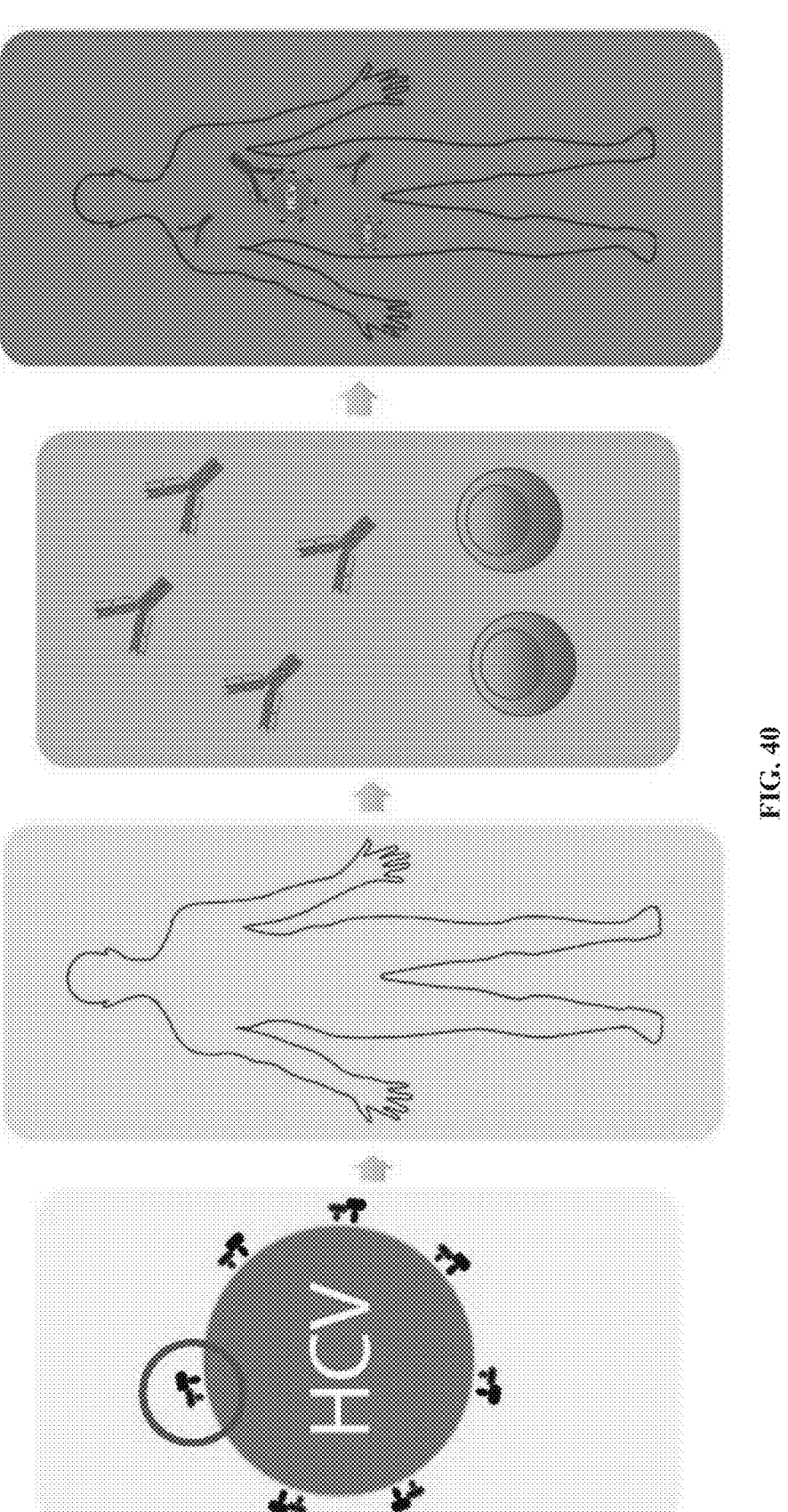
FIG. 40 shows immune responses during HCV infection. HCV the sole target of the neutralizing antibody response is the E1E2 glycoprotein heterodimer. The virus infects a person, and the person makes antibodies against the virus. These antibodies can then bind the virus and may lead to an initial suppression of viremia, but ultimately in 60-80% of the cases the immune system fails to clear the virus and it turns into chronic infection.
Figure 41:
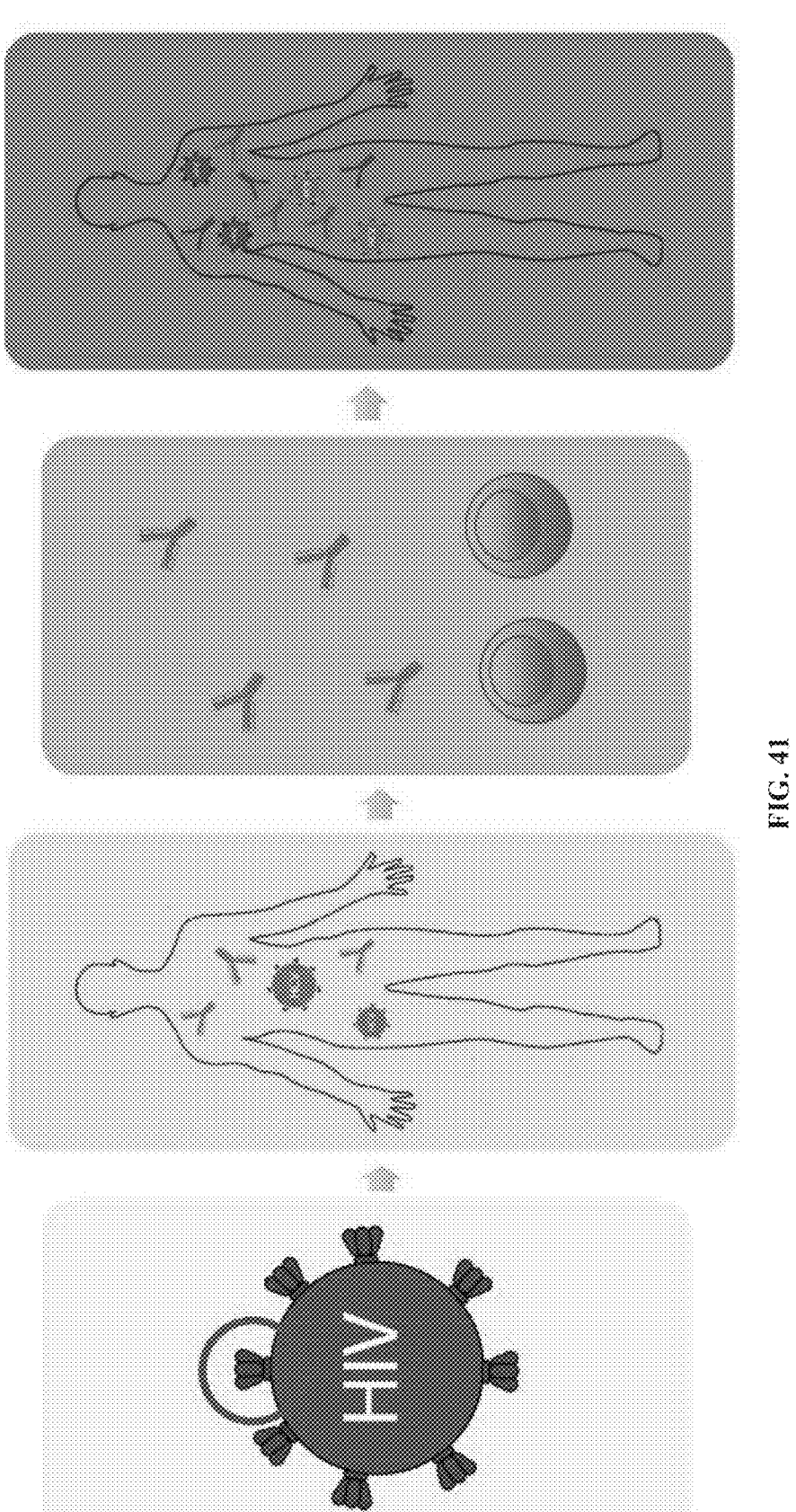
FIG. 41 shows immune responses during HCV/HIV co-infection. Target of the neutralizing antibody response during HIV infection is the envelope glycoprotein, Env.
Figures 42, 43:
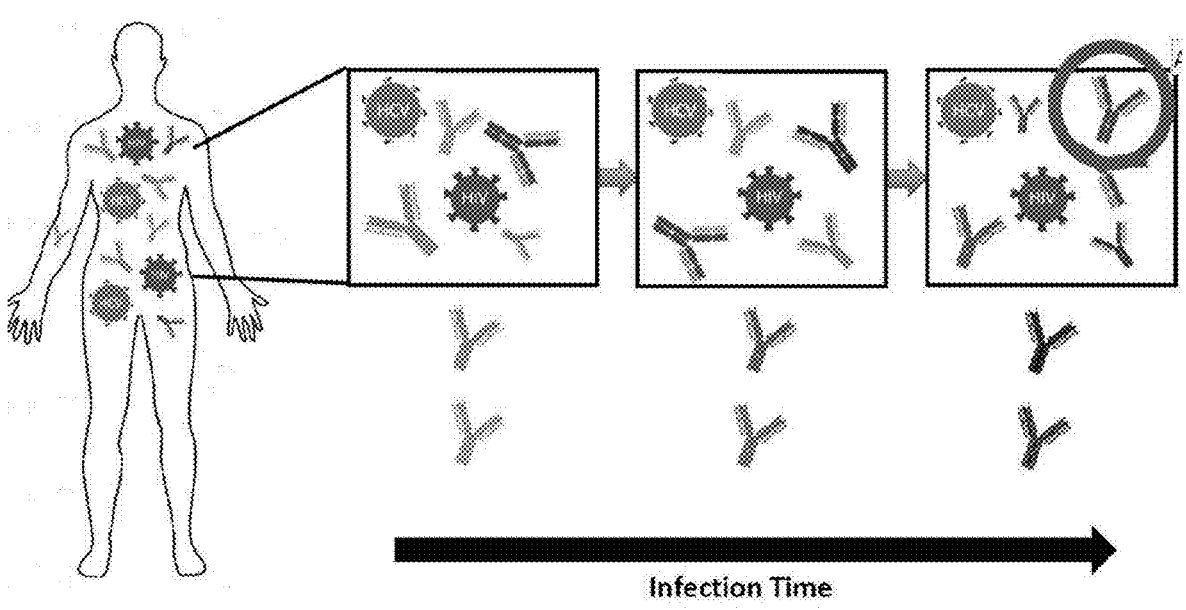
FIG. 42 shows antibody responses during chronic HIV/HCV co-infection. Over the course of chronic infection, the antibody response continues to develop, acquiring mutations and expanding. In this schematic, the darkening colors of the antibodies are meant to represent this development over time. The red antibodies recognizing HIV and the blue antibodies recognizing HCV. The "purple" antibodies (circled) are those can recognize both viruses.
FIG. 43 shows the information of the Vanderbilt HIV Cohort.
Figures 44, 45:
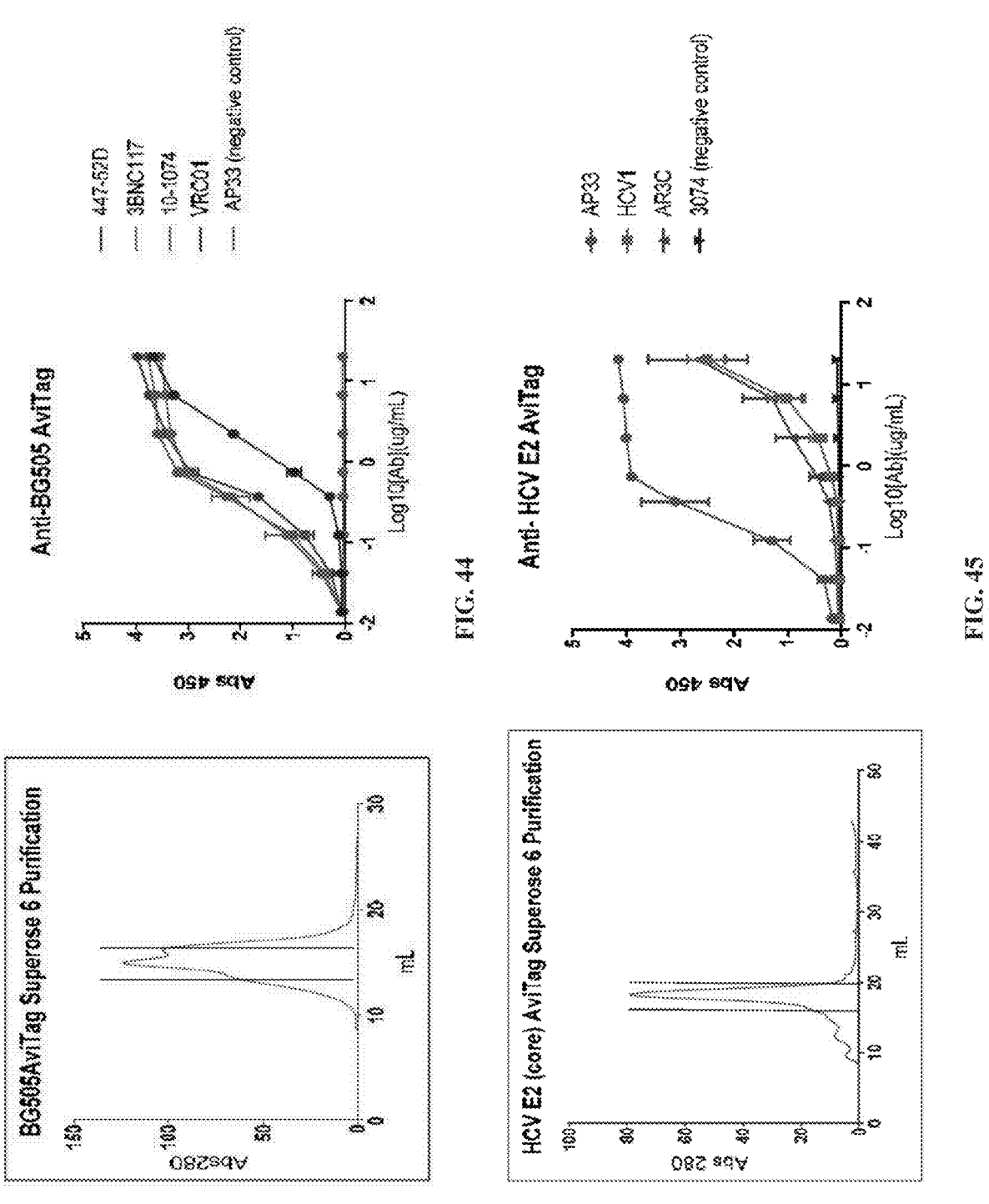
FIG. 44 shows the purification of HIV Env: BG505 SOSIP.664 AVITAG™. VRC01 binds cd4bs (Wu et al Science 2009); 10-1074 binds glycan patch; 3BNC117 binds CD4bs; PGT145 binds v1v2 quaternary trimer specific epitope 447-52D V3 directed antibody.
FIG. 45 shows the purification of HCV Env: E2 (core) AVITAG™
Figure 46:
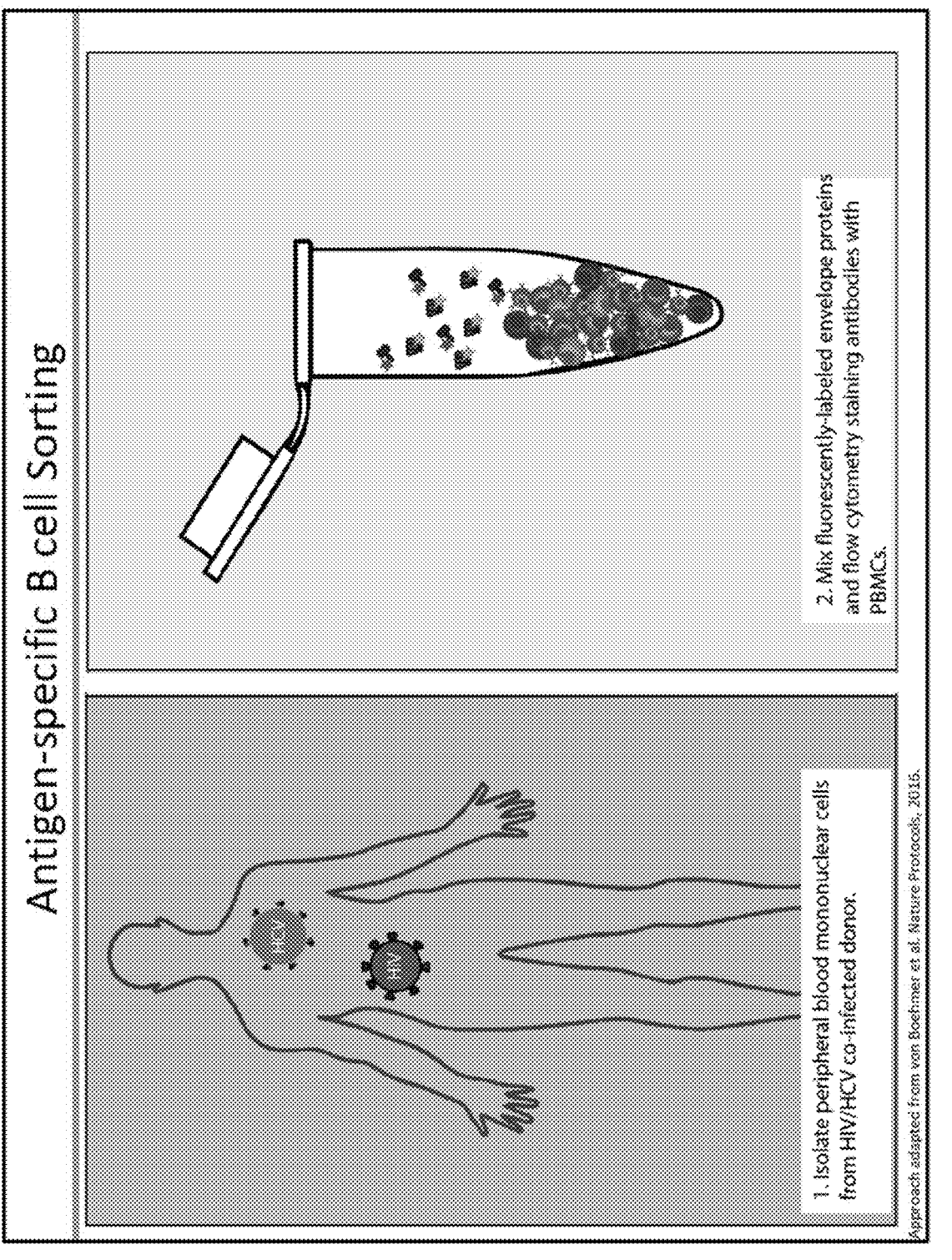
FIG. 46 shows antigen-specific B cell sorting. Peripheral blood mononuclear cells (PBMC) were isolated from HIV/HCV co-infected donors. Then the PBMCs were mixed with fluorescently-labeled proteins and flow cytometry staining antibodies.
Figure 47:
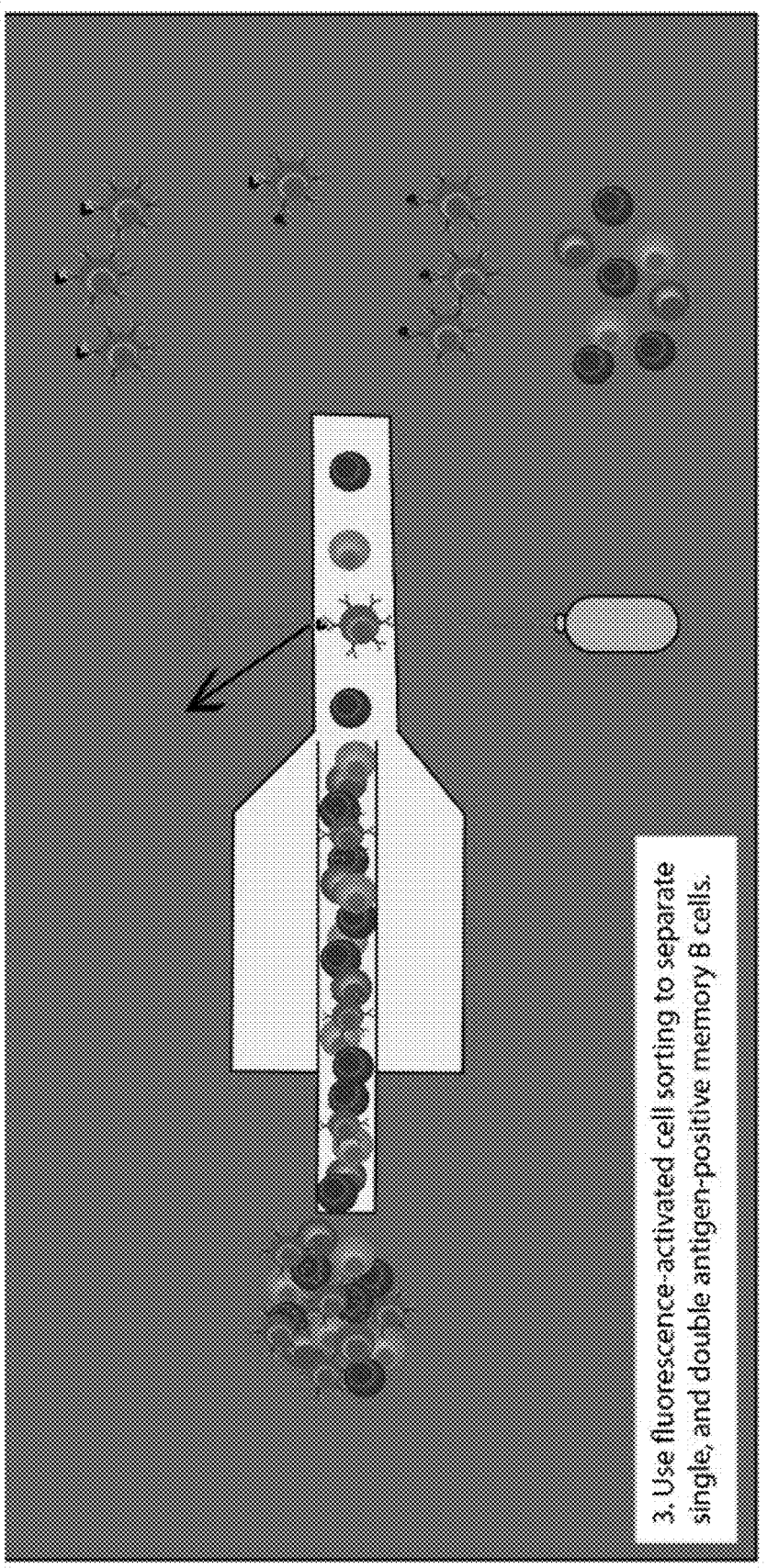
FIG. 47 shows antigen-specific B cell sorting.
Figure 48:
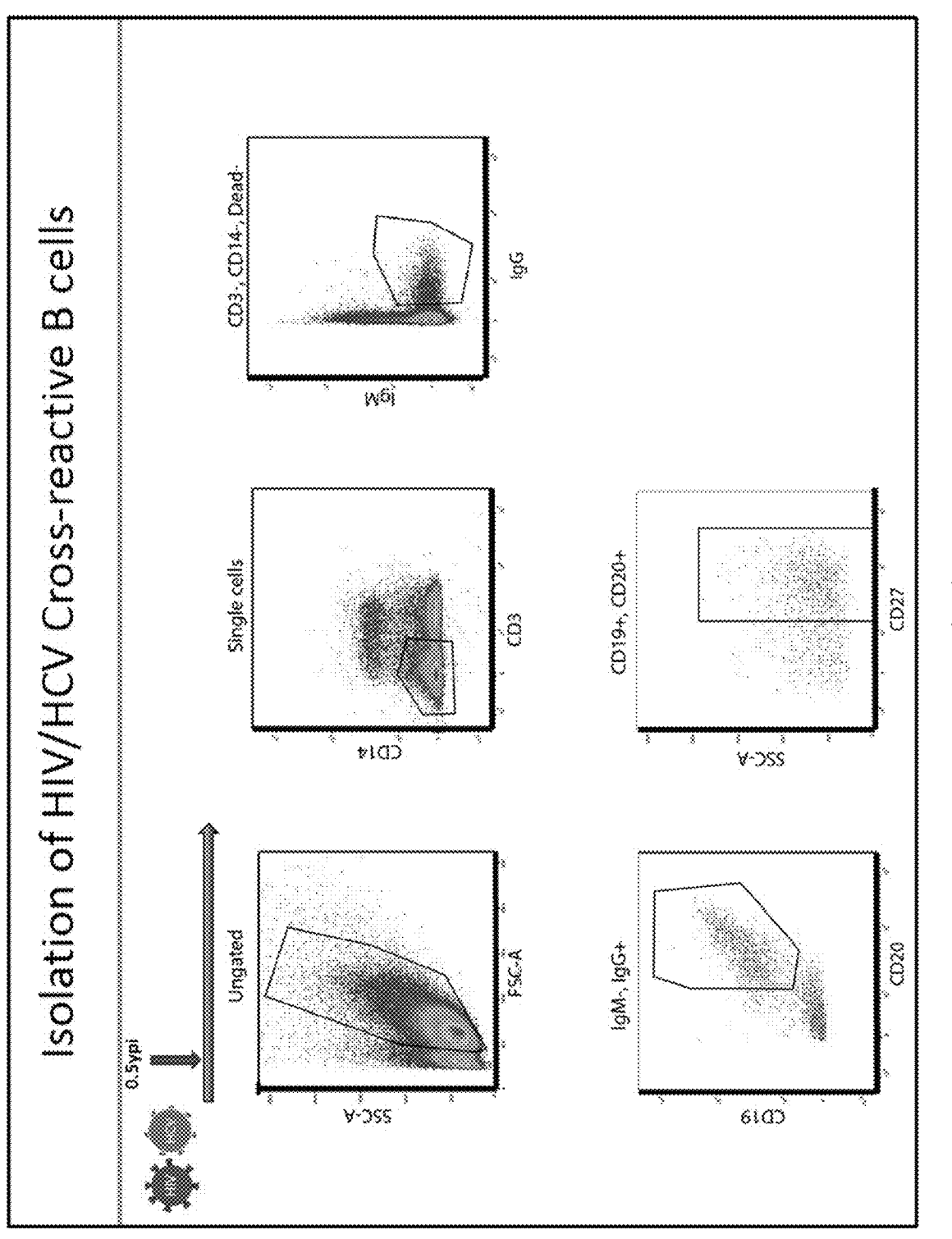
FIG. 48 shows isolation of HIV/HCV cross-reactive B cells.
Figure 48:
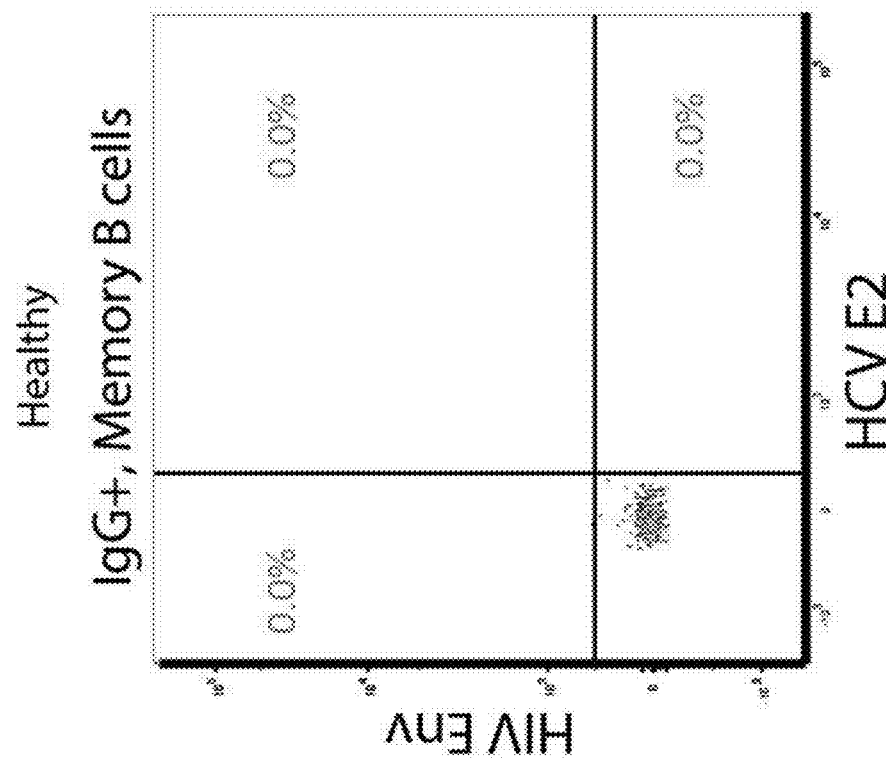
Figure 48:
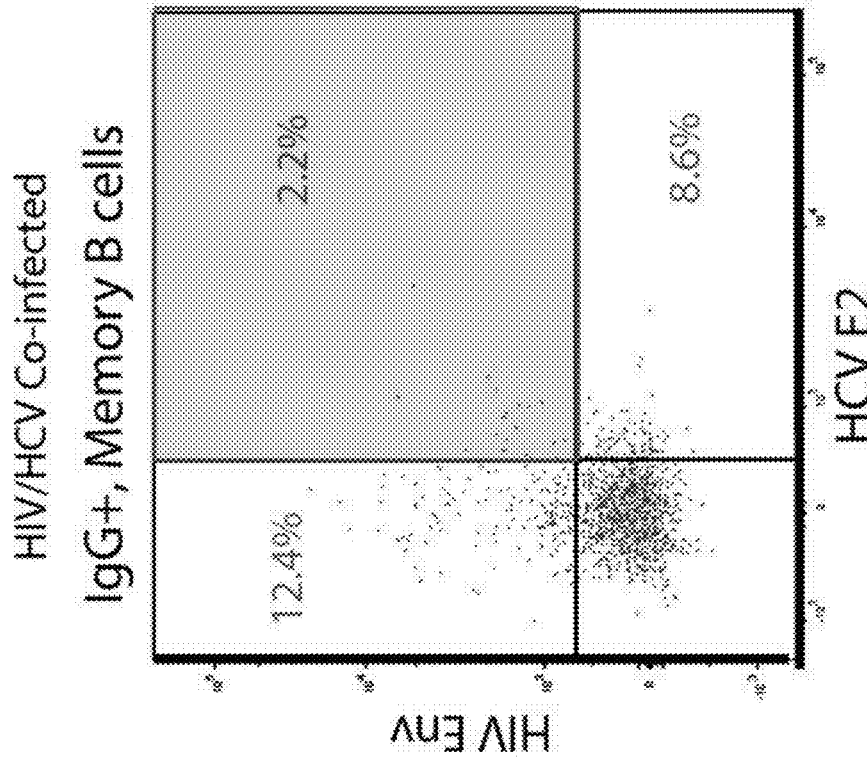
Figures 49A, 49B:
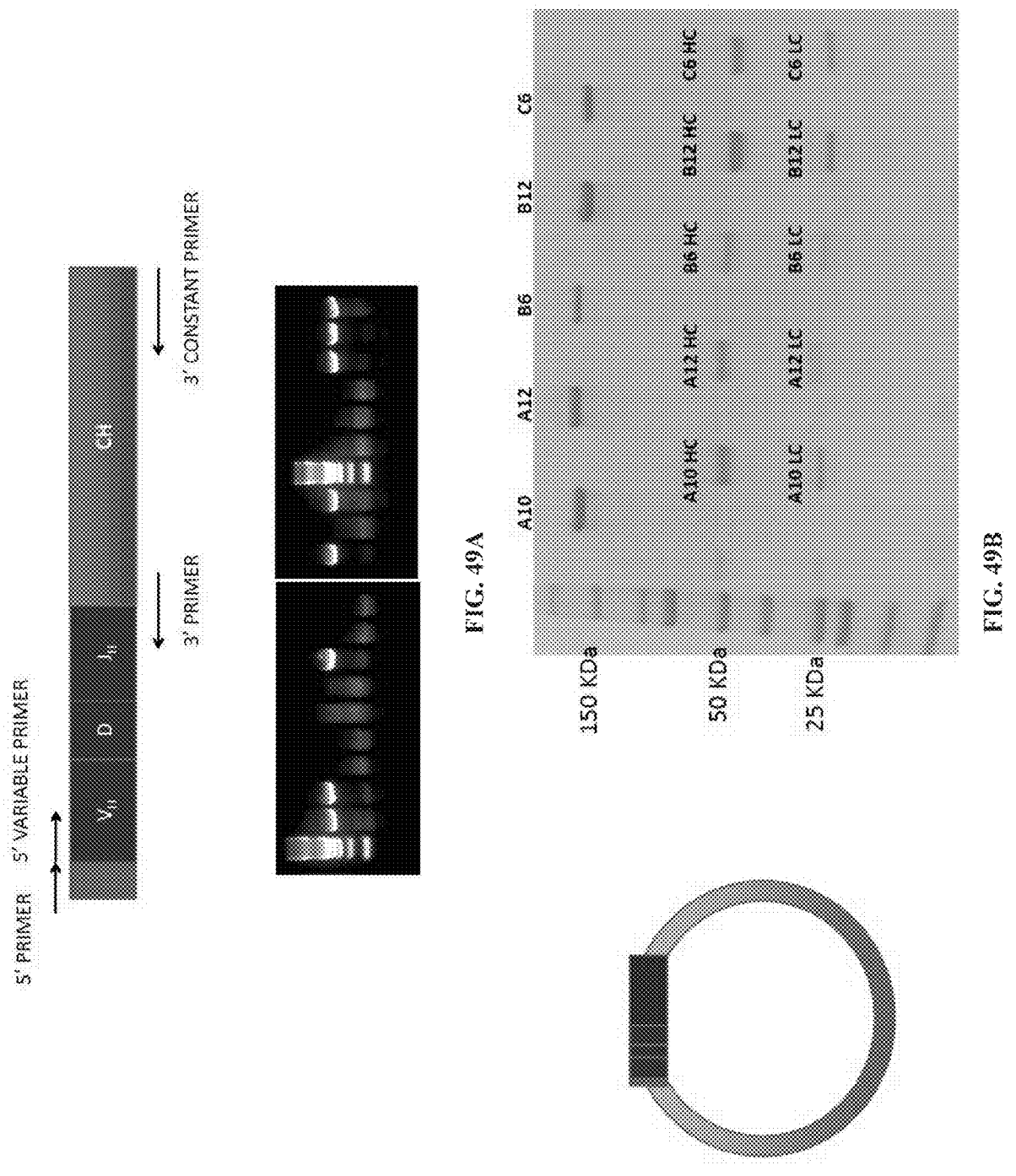
FIGS. 49A-49B show single B cell receptor PCR and protein expression.
Figure 50:
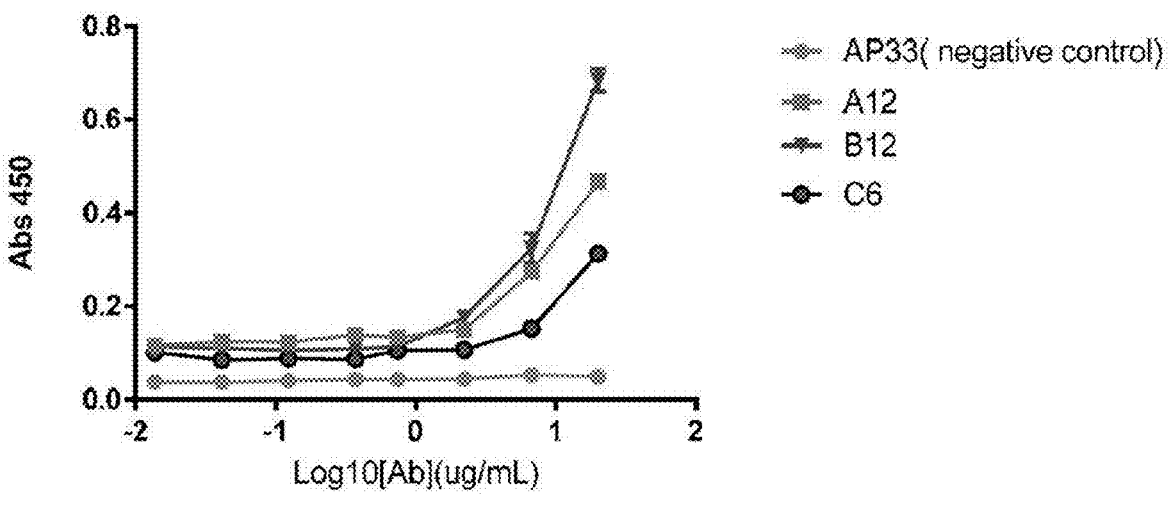
FIG. 50 shows HIV/HCV cross-reactive antibodies binding BG505 AVITAG™.
Figure 51:
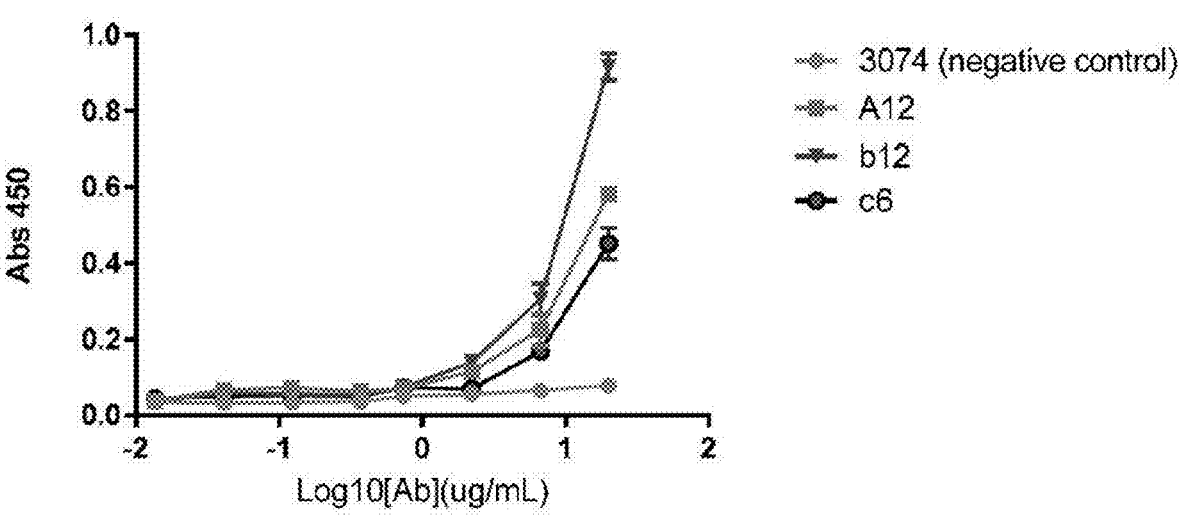
FIG. 51 shows HIV/HCV cross-reactive antibodies binding E2 (core) AVITAG™.
Figures 52, 53:
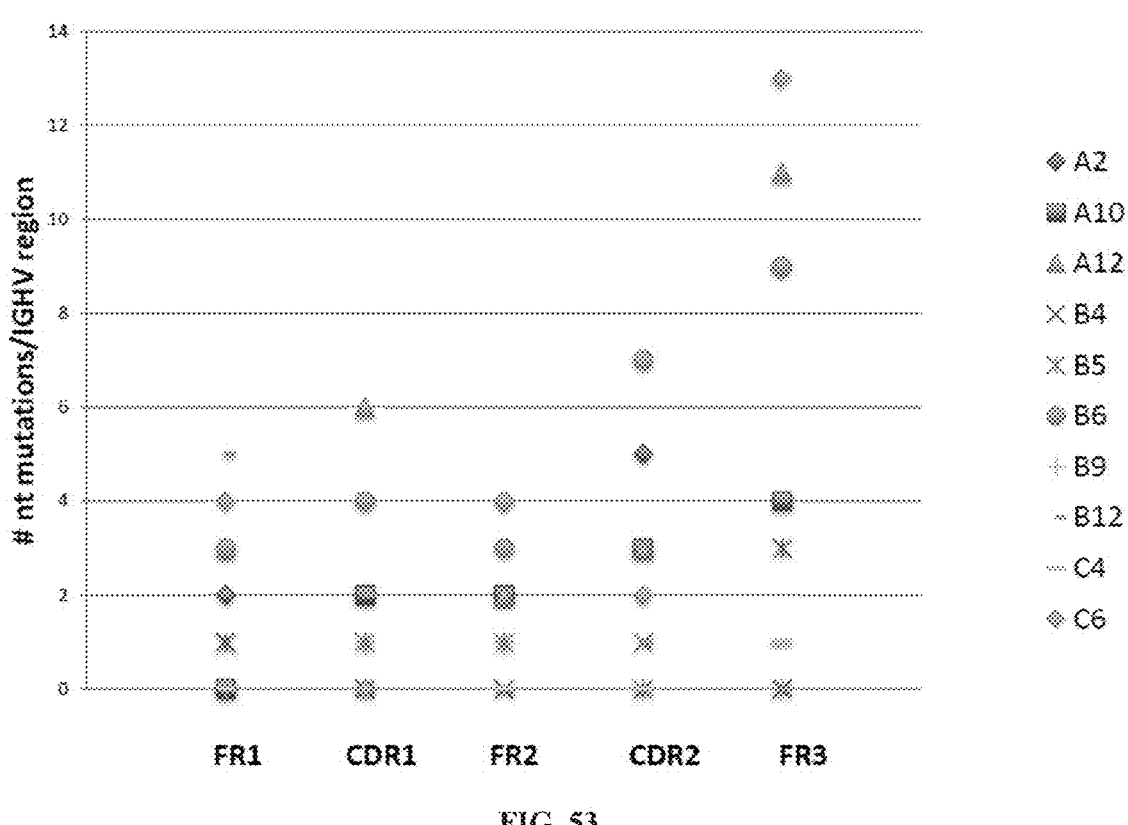
FIG. 52 shows isolated HIV/HCV cross-reactive antibodies derive from different germline genes. Sequences in FIG. 52: CAREQRDYXSGFDYW (SEQ ID NO: 13138); CARLRRDGSYHHGAPFYFDNW (SEQ ID NO: 13139); CARGGYQDSAGYADYW (SEQ ID NO: 13140); CARG-GRDLVRGLVMTDFFDEW (SEQ ID NO: 13141); CARLRWSSSWYYRFDYW (SEQ ID NO: 13142); CTTAFSMKYCSSTNCPRSDWYFDLW (SEQ ID NO: 13143).
FIG. 53 shows cross-reactive antibody sequences, HIV/HCV cross-reactive antibody VH mutations.
Figure 54:
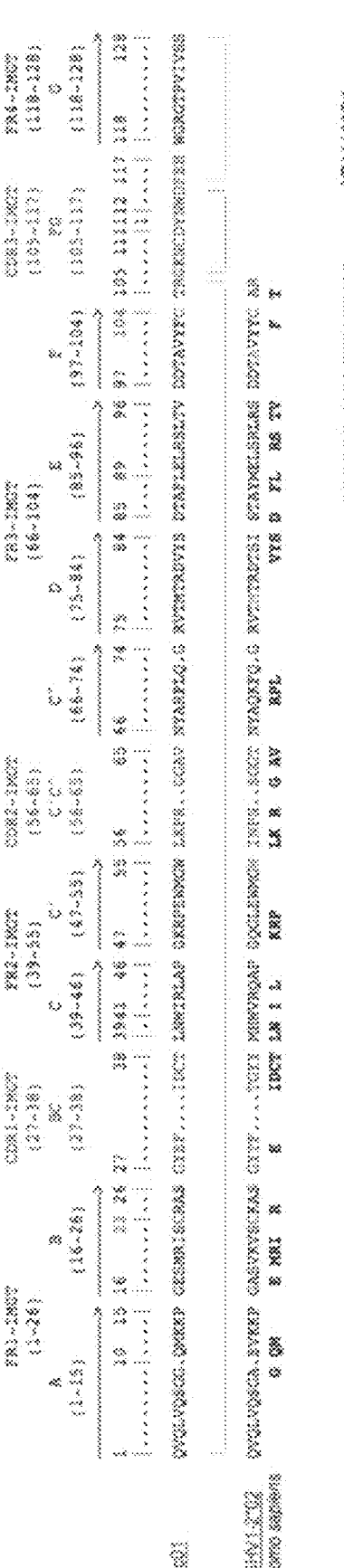
FIG. 54 shows B12 antibody sequence aligned to the reference IMGT database to identify which gene alleles are used. Sequences in FIG. 54.

In some embodiments, the CDRH3 sequence comprise a sequence shown in FIG. 28. In some embodiments, the CDRH3 sequence comprise a sequence shown in FIG. 30. In some embodiments, the CDRL3 sequence comprise a sequence shown in FIG. 28. In some embodiments, the CDRL3 sequence comprise a sequence shown in FIG. 30.

Methods

Disclosed herein are methods for preventing, treating, inhibiting, or reducing HIV and/or HCV infection.

In some aspects, disclosed herein is a method of producing a recombinant antibody comprising cultivating or maintaining the host cell of any preceding aspect under conditions to produce a recombinant antibody as described herein.

In some aspects, disclosed herein is a method of treating, preventing, reducing, and/or inhibiting HIV infection, HCV, infection, or HIV/HCV co-infection, comprising administering to a subject a therapeutically effective amount of a recombinant antibody, wherein the recombinant antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein CDRL3 comprises an amino acid sequence at least 60% identical to

```
                                    (SEQ ID NO: 13)
MQPLQLPDT, (SEQ ID NO: 25)
QQSYNVPT, (SEQ ID NO: 39)
HQSSSLPFT, (SEQ ID NO: 49)
QHFYSSPPT, (SEQ ID NO: 88)
CLYAGSYSWV,
or (SEQ ID NO: 101)
QVWDSSSEHVV;
``` and/or
CDRH3 comprises an amino acid sequence at least 60% identical to

```
                                    (SEQ ID NO: 104)
ARVAPPGVVNNKWFDI, (SEQ ID NO: 110)
ARSEKRVTMTRKIKGRWFGP, (SEQ ID NO: 1817)
CAAGLWSGDLSRPRYSDSW, (SEQ ID NO: 1818)
CAKGLTTESRLEFW, (SEQ ID NO: 1819)
CVSSWGPESPYYFDYW,
or (SEQ ID NO: 1820)
CAREYCTGGDCHFFLDYW.
```

In some aspects, disclosed herein is a method of treating, preventing, reducing, and/or inhibiting HIV infection, HCV, infection, or HIV/HCV co-infection, comprising administering to a subject a therapeutically effective amount of a recombinant antibody, wherein the recombinant antibody comprises a light chain variable region (VL) that comprises a light chain complementarity determining region (CDRL) 1, CDRL2, and CDRL3 or a heavy chain variable region (VH) that comprises a heavy chain complementarity determining region (CDRH) 1, CDRH2, and CDRH3, wherein CDRL3 comprises an amino acid sequence at least 60% identical to

```
                                    (SEQ ID NO: 13)
MQPLQLPDT, (SEQ ID NO: 25)
QQSYNVPT, (SEQ ID NO: 39)
HQSSSLPFT, (SEQ ID NO: 49)
QHFYSSPPT, (SEQ ID NO: 88)
CLYAGSYSWV,
or (SEQ ID NO: 101)
QVWDSSSEHVV;
``` and/or
CDRH3 comprises an amino acid sequence at least 60% identical to

```
                                    (SEQ ID NO: 104)
ARVAPPGVVNNKWFDI, (SEQ ID NO: 110)
ARSEKRVTMTRKIKGRWFGP, (SEQ ID NO: 1817)
CAAGLWSGDLSRPRYSDSW, (SEQ ID NO: 1818)
CAKGLTTESRLEFW, (SEQ ID NO: 1819)
CVSSWGPESPYYFDYW,
or (SEQ ID NO: 1820)
CAREYCTGGDCHFFLDYW.
```

In some embodiments, the CDRL3 comprises at least one amino acid substitution when compared to SEQ ID NO: 13, 25, 39, 49, 88, or 101.

In some embodiments, the at least one amino acid substitution is selected from the group consisting of
a) at position 1 when compared to SEQ ID NO: 13, wherein the substituting amino acid residue is K;
b) at position 3 when compared to SEQ ID NO: 13, wherein the substituting amino acid residue is selected from the group consisting of A, T, G, V, D, Y, and F;
c) at position 6 when compared to SEQ ID NO: 13, wherein the substituting amino acid residue is selected from the group consisting of H, S, T, P, I, V, P, R, and V;
d) at position 9 when compared to SEQ ID NO: 13, wherein the substituting amino acid residue is selected from the group consisting of Y, L, H, P, I, G, C, J, R, and Q;

e) at position 5 when compared to SEQ ID NO: 25, wherein the substituting amino acid residue is selected from the group consisting of T, P, Y, R, I, G, and S;

f) at position 6 when compared to SEQ ID NO: 25, wherein the substituting amino acid residue is selected from the group consisting of A, T, and P;

g) at position 7 when compared to SEQ ID NO: 25, wherein the substituting amino acid residue is selected from the group consisting of W, A, R, G and L;

h) at position 3 when compared to SEQ ID NO: 39, wherein the substituting amino acid residue is T;

i) at position 4 when compared to SEQ ID NO: 39, wherein the substituting amino acid residue is selected from the group consisting of R, G, T, Y, A, and K;

j) at position 6 when compared to SEQ ID NO: 39, wherein the substituting amino acid residue is F;

k) at position 7 when compared to SEQ ID NO: 39, wherein the substituting amino acid residue is selected from the group consisting of G, Q, L, and S.

l) at position 8 when compared to SEQ ID NO: 39, wherein the substituting amino acid residue is selected from the group consisting of G, Q, Y, W, H, and L;

m) at position 9 when compared to SEQ ID NO: 39, wherein the substituting amino acid residue is selected from the group consisting of A, P, and S.

n) at position 3 when compared to SEQ ID NO: 49, wherein the substituting amino acid residue is L;

o) at position 5 when compared to SEQ ID NO: 49, wherein the substituting amino acid residue is T;

p) at position 6 when compared to SEQ ID NO: 49, wherein the substituting amino acid residue is selected from the group consisting of N, D, and K;

q) at position 2 when compared to SEQ ID NO: 88, wherein the substituting amino acid residue is selected from the group consisting of S, P and T;

r) at position 6 when compared to SEQ ID NO: 88, wherein the substituting amino acid residue is R;

s) at position 8 when compared to SEQ ID NO: 88, wherein the substituting amino acid residue is selected from the group consisting of N, W, and T;

t) at position 9 when compared to SEQ ID NO: 88, wherein the substituting amino acid residue is A;

u) at position 2 when compared to SEQ ID NO: 101, wherein the substituting amino acid residue is selected from the group consisting of M, A, and L;

v) at position 3 when compared to SEQ ID NO: 101, wherein the substituting amino acid residue is C;

w) at position 4 when compared to SEQ ID NO: 101, wherein the substituting amino acid residue is Y;

x) at position 7 when compared to SEQ ID NO: 101, wherein the substituting amino acid residue is N; and y) at position 8 when compared to SEQ ID NO: 101, wherein the substituting amino acid residue is D.

In some embodiments, the CDRL3 comprises an amino acid sequence selected from the group consisting of SEQ ID NOs: 1-12, 14-24, 26-38, 40-48, 50-87, and 89-100. In some embodiments, the CDRL3 comprises an amino acid sequence selected from the group consisting of SEQ ID NOs: 1-12, 14-24, 26-38, 40-48, 50-51, and 89-100.

In some embodiments, the VL comprises an amino acid sequence selected from the group consisting of SEQ ID NOs: 119-1693.

In some embodiments, the CDRL3 comprises an amino acid sequence selected from SEQ ID NOs: 13, 25, 39, 49, 88, 101, and 1883-1888. In some embodiments, the CDRL1 comprises an amino acid sequence selected from SEQ ID NOs: 13120-13125. In some embodiments, the CDRL2 comprises an amino acid sequence selected from SEQ ID NOs: 13126-13131.

In some embodiments, the VL comprises an amino acid sequence selected from SEQ ID NOs: 119, 227, 242, 351, 1399, 1406, and 1899-1904.

In some embodiments, the CDRH3 comprises at least one amino acid substitution when compared to SEQ ID NO: 104, 110, 1817, 1818, 1819, or 1820. In some embodiments, the at least one amino acid substitution is selected from the group consisting of a) at position 3 when compared to SEQ ID NO: 104, wherein the substituting amino acid residue is G or I;

b) at position 4 when compared to SEQ ID NO: 104, wherein the substituting amino acid residue is S, T, or P;

c) at position 9 when compared to SEQ ID NO: 104, wherein the substituting amino acid residue is A;

d) at position 11 when compared to SEQ ID NO: 104, wherein the substituting amino acid residue is K or H;

e) at position 14 when compared to SEQ ID NO: 104, wherein the substituting amino acid residue is L;

f) at position 16 when compared to SEQ ID NO: 104, wherein the substituting amino acid residue is L or T;

g) at position 1 when compared to SEQ ID NO: 110, wherein the substituting amino acid residue is T or S;

h) at position 5 when compared to SEQ ID NO: 110, wherein the substituting amino acid residue is N or P;

i) at position 7 when compared to SEQ ID NO: 110, wherein the substituting amino acid residue is I, N, K, or L;

j) at position 9 when compared to SEQ ID NO: 110, wherein the substituting amino acid residue is L or T;

k) at position 10 when compared to SEQ ID NO: 110, wherein the substituting amino acid residue is A or V;

l) at position 11 when compared to SEQ ID NO: 110, wherein the substituting amino acid residue is L.

m) at position 17 when compared to SEQ ID NO: 110, wherein the substituting amino acid residue is S;

n) at position 19 when compared to SEQ ID NO: 110, wherein the substituting amino acid residue is D; and o) at position 20 when compared to SEQ ID NO: 110, wherein the substituting amino acid residue is S.

In some embodiments, the CDRH3 comprises an amino acid sequence selected from the group consisting of SEQ ID NOs: 102-103, 105-109, and 111-118.

In some embodiments, the VH comprises an amino acid sequence selected from the group consisting of SEQ ID NOs: 1694-1756.

In some embodiments, the CDRH3 comprises an amino acid sequence selected from the group consisting of SEQ ID NOs: 104, 110, and 1817-1822. In some embodiments, the CDRH1 comprises an amino acid sequence selected from SEQ ID NOs: 13102-13107. In some embodiments, the CDRH2 comprises an amino acid sequence selected from SEQ ID NOs: 13108-13113.

In some embodiments, the CDRH3 comprises an amino acid sequence selected from the group consisting of SEQ ID NOs: 13138-13143, 13148-13150, and 13153-13155.

In some embodiments, the CDRL3 comprises an amino acid sequence selected from the group consisting of SEQ ID NOs: 13151 and 13152.

In some embodiments, the recombinant antibody disclosed herein comprises an amino acid sequence selected from SEQ ID NOs: 13144, 13145, 13146, and 13147.

In some embodiments, the VH comprises an amino acid sequence selected from the group consisting of SEQ ID NOs: 1895-1898, 1694, and 1718.

In some embodiments, the recombinant antibody disclosed herein is selected from the group consisting of a) a recombinant antibody comprising the CDRL3 of SEQ ID NO: 88 or 1887 and the CDRH3 of SEQ ID NO: 104 or 1821;

b) a recombinant antibody comprising the CDRL3 of SEQ ID NO: 101 or 1888 and the CDRH3 of SEQ ID NO: 110 or 1822;

c) a recombinant antibody comprising the CDRL3 of SEQ ID NO: 13 or 1883 and the CDRH3 of SEQ ID NO: 1817;

d) a recombinant antibody comprising the CDRL3 of SEQ ID NO: 25 or 1884 and the CDRH3 of SEQ ID NO: 1818;

e) a recombinant antibody comprising the CDRL3 of SEQ ID NO: 39 or 1885 and the CDRH3 of SEQ ID NO: 1819; and f) a recombinant antibody comprising the CDRL3 of SEQ ID NO: 49 or 1886 and the CDRH3 of SEQ ID NO: 1820.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13102,
CDRH2 is SEQ ID NO: 13108,
CDRH3 is SEQ ID NO: 1817,
CDRL1 is SEQ ID NO: 13120,
CDRL2 is SEQ ID NO: 13126, and
CDRL3 is SEQ ID NO: 13 or 1883.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13103,
CDRH2 is SEQ ID NO: 13109,
CDRH3 is SEQ ID NO: 1818,
CDRL1 is SEQ ID NO: 13121,
CDRL2 is SEQ ID NO: 13127, and
CDRL3 is SEQ ID NO: 25 or 1884.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13104,
CDRH2 is SEQ ID NO: 13110,
CDRH3 is SEQ ID NO: 1819,
CDRL1 is SEQ ID NO: 13122,
CDRL2 is SEQ ID NO: 13128, and
CDRL3 is SEQ ID NO: 39 or 1885.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13105,
CDRH2 is SEQ ID NO: 13111,
CDRH3 is SEQ ID NO: 1820,
CDRL1 is SEQ ID NO: 13123,
CDRL2 is SEQ ID NO: 13129, and
CDRL3 is SEQ ID NO: 49 or 1886.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13106,
CDRH2 is SEQ ID NO: 13112,
CDRH3 is SEQ ID NO: 104 or 1821,
CDRL1 is SEQ ID NO: 13124,
CDRL2 is SEQ ID NO: 13130, and
CDRL3 is SEQ ID NO: 88 or 1887.

In some embodiments, the antibody comprises a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

CDRH1 is SEQ ID NO: 13107,
CDRH2 is SEQ ID NO: 13113,
CDRH3 is SEQ ID NO: 110 or 1822,
CDRL1 is SEQ ID NO: 13125,
CDRL2 is SEQ ID NO: 13131, and
CDRL3 is SEQ ID NO: 101 or 1888.

In some embodiments, the recombinant antibody binds to at least one HIV antigen and/or at least one HCV antigen.

In some aspects, disclosed herein is a method of producing a recombinant antibody comprising cultivating or maintaining the host cell of any preceding aspect under conditions to produce said recombinant antibody.

In some aspects, disclosed herein is a method of treating, preventing, reducing, and/or inhibiting HIV/HCV co-infection comprising administering to a subject a therapeutically effective amount of the recombinant antibody of any preceding aspect.

In some aspects, disclosed herein is a method of treating, preventing, reducing, and/or inhibiting HIV infection comprising administering to a subject a therapeutically effective amount of the recombinant antibody of any preceding aspect.

In some aspects, disclosed herein is a method of treating, preventing, reducing, and/or inhibiting HCV infection comprising administering to a subject a therapeutically effective amount of the recombinant antibody of any preceding aspect.

EXAMPLES

The following examples are set forth below to illustrate the antibodies, methods, and results according to the disclosed subject matter. These examples are not intended to be inclusive of all aspects of the subject matter disclosed herein, but rather to illustrate representative methods and results. These examples are not intended to exclude equivalents and variations of the present invention which are apparent to one skilled in the art.

Example 1. HIV/HCV Cross-Reactive Antibodies

Investigating the human antibody response to HIV and HCV has led to significant advances towards preventative therapeutics and vaccines against these highly mutable pathogens. Yet, despite the high prevalence of HIV/HCV co-infection, little is known about antibody responses in this context. Hence, the effect of chronic co-infection with HIV and HCV on the development of virus-specific humoral responses is investigated. The present disclosure shows that chronic HIV/HCV co-infection leads to the development of HIV and HCV cross-reactive antibodies and that these antibodies evolve from polyreactive precursors or from one virus-specific lineage that acquires additional specificity through hypermutation. Gaining such an understanding provides insights into the interplay between the pathogen-specific portions of the antibody repertoires in co-infected individuals, and also provides significant implications for how antibody-specific vaccine development can be adapted to fit the specific immunological requirements during chronic co-infection. Accordingly, the antibody repertoires of HIV/HCV co-infected individuals were investigated, for which there are samples available from multiple timepoints.

Antibody responses to HIV and HCV on their own have been studied extensively, revealing a potential for such antibodies as therapeutics and as targets for antibody-specific vaccine development. The analysis herein investigates the chronic infection timepoints at which both HIV-1 and HCV infections are already present. While a comparison to pre-infection timepoints for one or both infections, or timepoints after HCV clearance, can provide additional details about the evolution of antibody repertoires in co-infection, recent studies have shown that the diversity and potency of HCV-specific antibody repertoires rapidly decline after HCV clearance in co-infected individuals.

The co-infection samples analyzed herein have diverse timepoint ranges, from up to 3 to >20 years post HIV-1 infection, consistent with the chronic timepoints used for successfully identifying broadly neutralizing antibodies (bNAbs) in HIV-only infection. Further, chronic infection timepoints are associated with persistent antigen exposure, which allows antibodies to acquire high levels of somatic hypermutation, leading to improved neutralization breadth and potency. Evidence from HIV-only work has shown that these antibodies can be of immense use as therapeutic and preventative tools for passive immunization in humans, as well as for defining antibody-specific vaccine templates capable of eliciting robust protective antibody responses upon immunization. To that end, it was investigated how chronic HIV/HCV coinfection, and therefore chronic stimulation with both HIV and HCV antigens, affects the development of neutralizing antibodies.

The examples herein address the interplay between HIV-specific and HCV-specific antibody lineages within a donor, generating novel insights into various factors, such as: (a) suppression of antibody lineages against one virus vs. the other, and (b) new epitopes that are targeted in a co-infection setting but not observed as immunodominant in samples from existing studies of HIV-only and HCV-only infections. Understanding such factors that pose different requirements for developing an effective HCV vaccine for individuals already infected with HIV-1 compared to individuals not infected with HIV-1 is of high significance. The identification of HIV/HCV cross-reactive antibodies provide new bNAb therapeutics that can neutralize both viruses, which has utility in passive immunization settings for co-infected individuals, analogously to the clinical applications of bNAbs in the HIV-only setting. Additionally, mapping the epitopes of the HIV/HCV cross-reactive antibodies provides for the identification of new epitope-specific vaccines that can protect against both viruses by eliciting such HIV/HCV cross-reactive antibodies.

Figure 1:
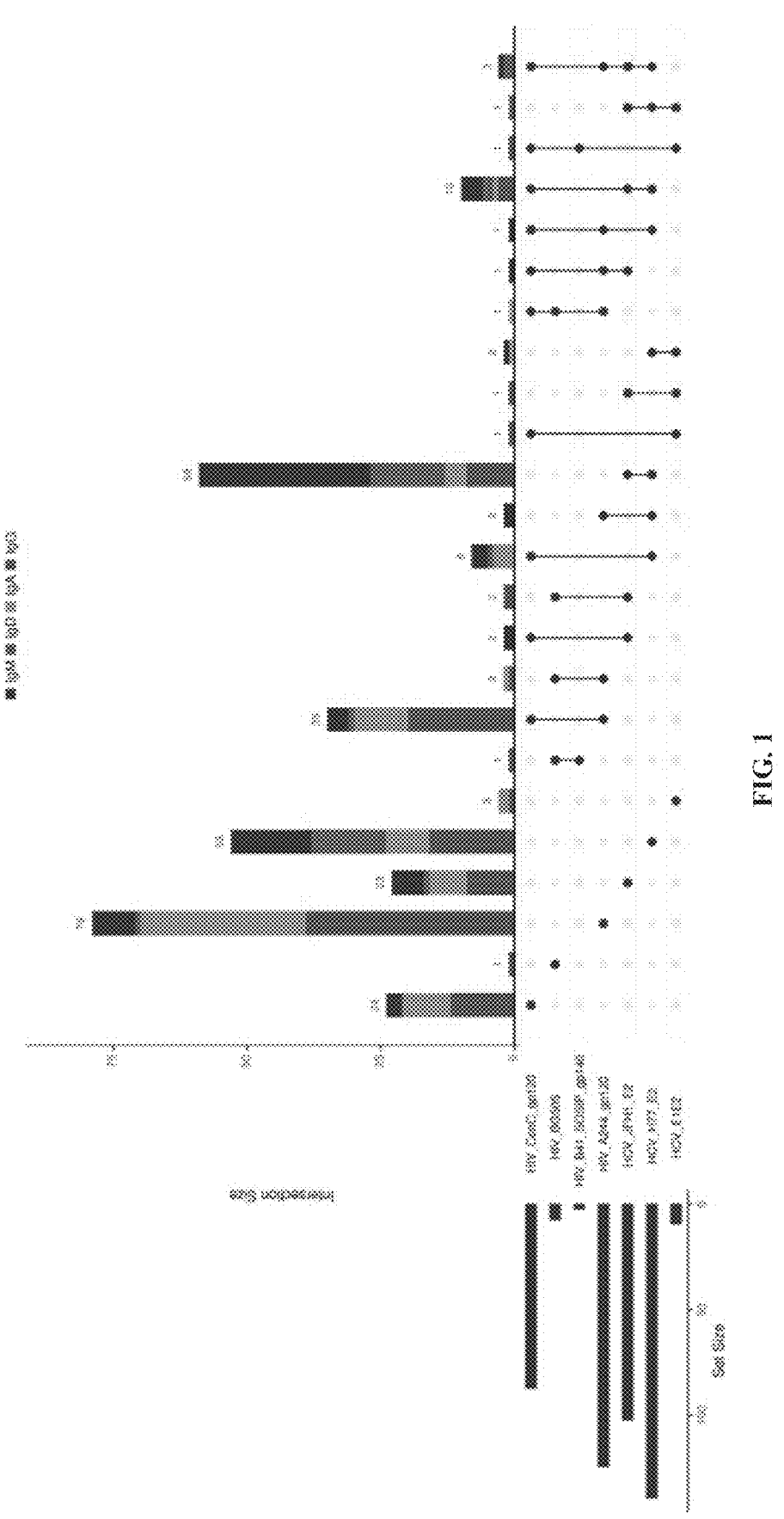
FIG. 1 shows that LIBRA-seq identifies spectrum of B cell specificity in HIV/HCV co-infection. Each sequenced cell is given a LIBRA-seq score for each antigen that defines its specificity. Shown here are the number of cells (intersection size) that were positive for a given specificity, shown underneath by shaded circles, colored by isotype frequency.
Figure 2:
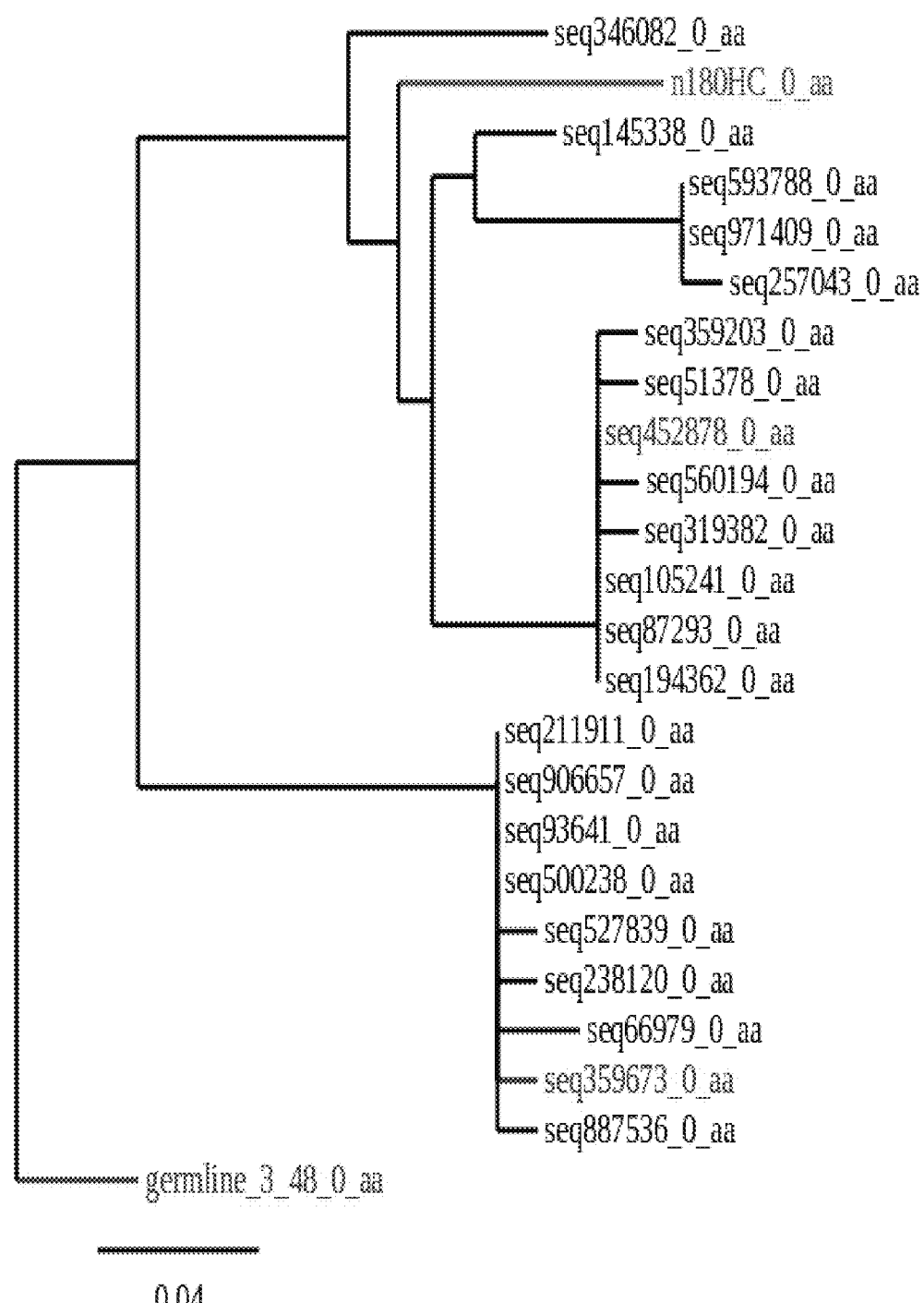
FIG. 2 shows phylogenetic analysis that identifies clonal relatives of HIV/HCV cross-reactive antibodies. Clonal relatives of HIV/HCV cross-reactive mAb180 were defined as sequences using the same V gene and sharing >70% CDRH3 identity. N180HC_0_aa denotes mAb180 isolated from 3.59ypi, all other sequences were identified 0.79ypi.
Figures 3, 4:
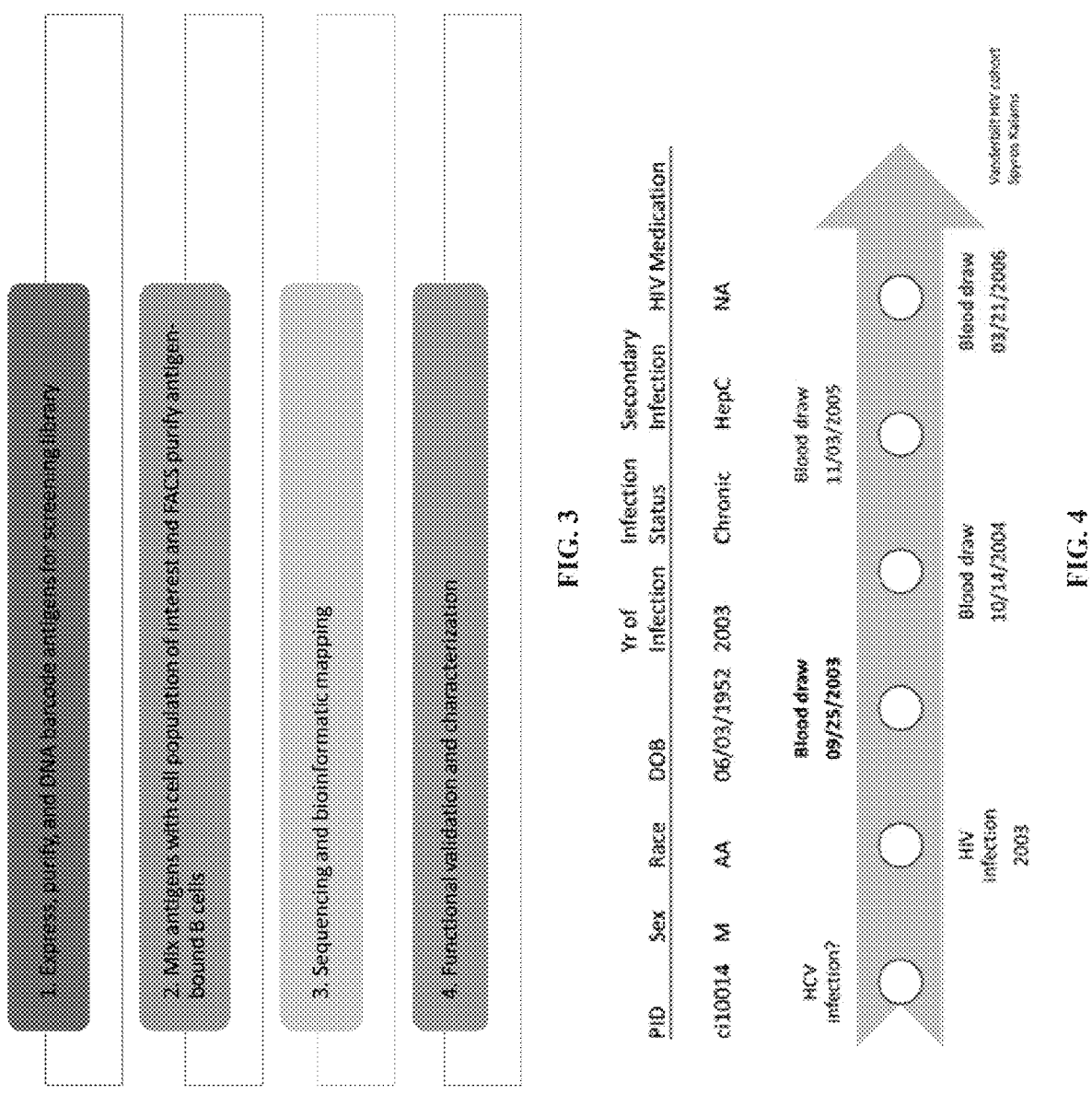
FIG. 3 shows an example workflow for LIBRA-seq experiments.
FIG. 4 shows that subsequent data was derived using a patient sample from a donor. Infection timepoints are shown. All LIBRA-seq data came from the Mar. 21, 2006 timepoint shown.
Figure 5:
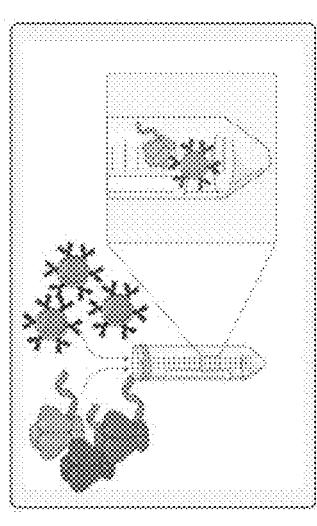
FIG. 5 shows experiment design. A diverse panel of HIV and HCV antigens were used to maximize the chance of pulling out HIV/HCV cross-reactive antibodies.
Figure 5:
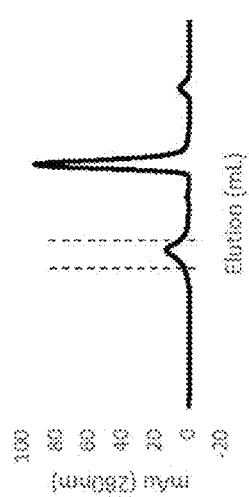
Figure 6:
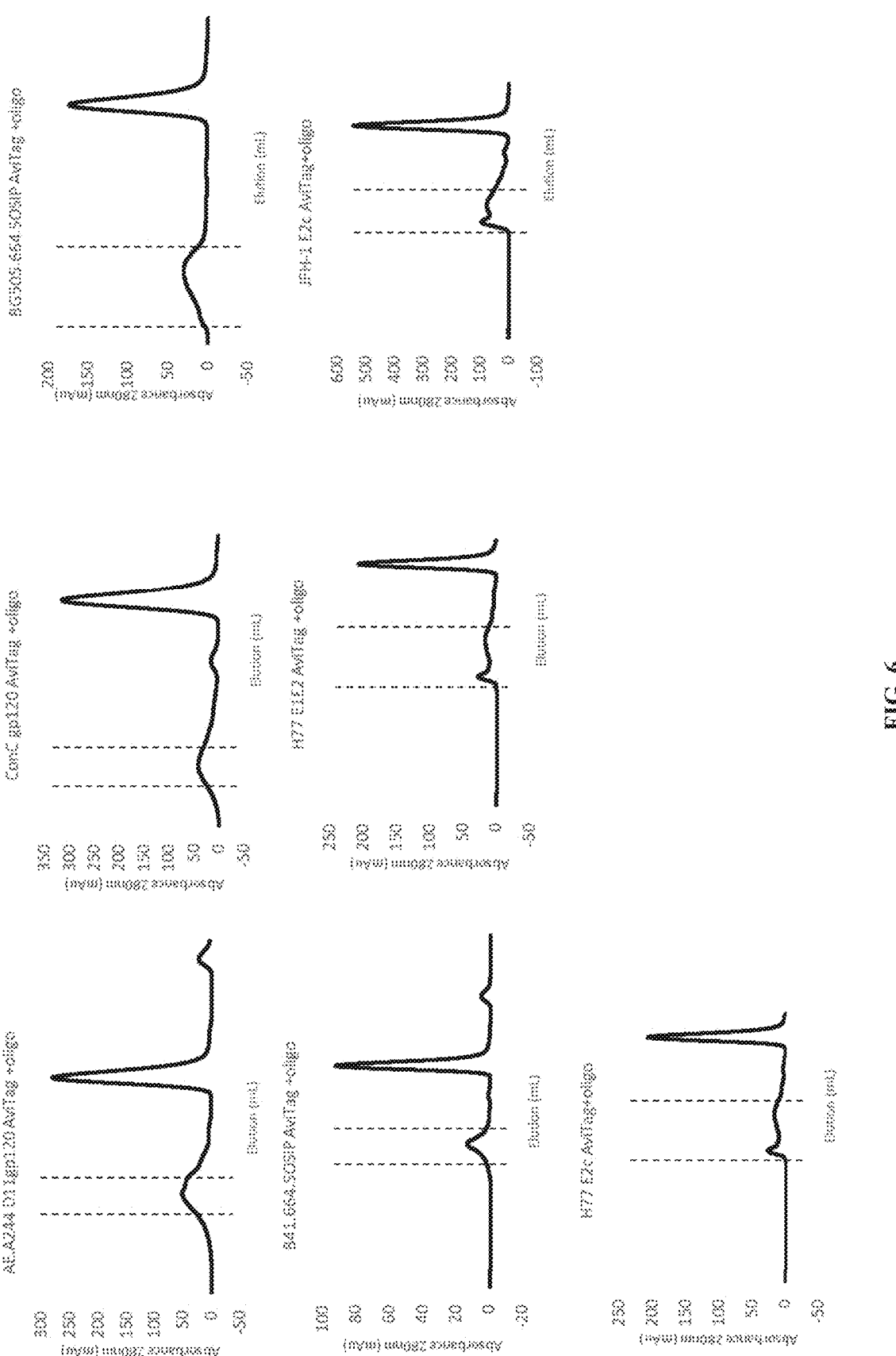
FIG. 6 shows LIBRA-seq works by tagging each antigen with its own unique oligonucleotide barcode. Only oligo-tagged antigens were purified by FPLC using a S200 SUPERDEX™ 10/300 GL column. Tagged antigens for sorting are denoted by dotted lines.
Figure 7:
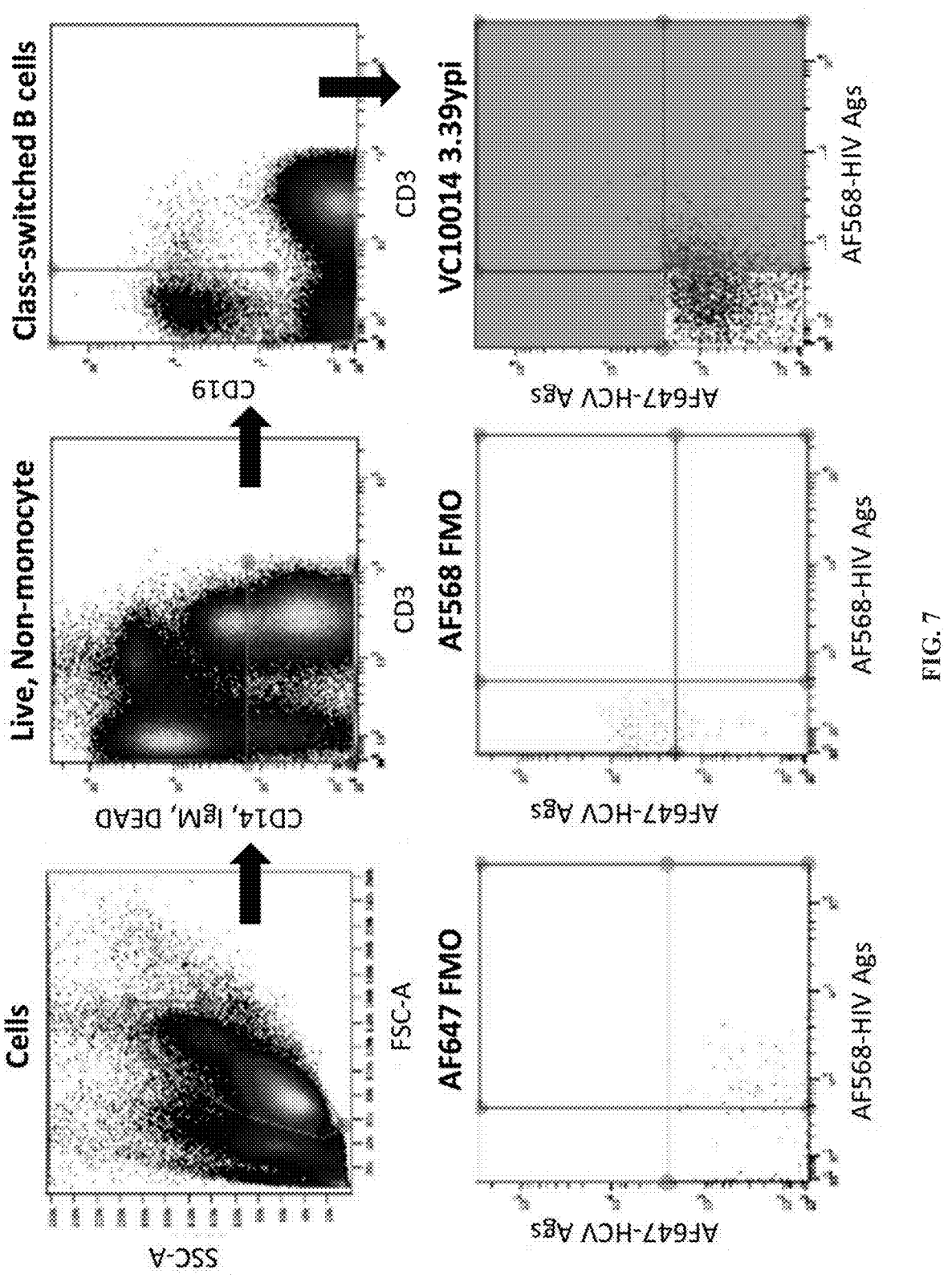
FIG. 7 shows Flow Sorting Strategy to Identify Antigen-specific B cells. B cells that have bound antigen were sorted out. B cells were separated from other cell populations using known markers. All cells that fall under the shaded squares were sorted for 10X sequencing.
Figure 8:
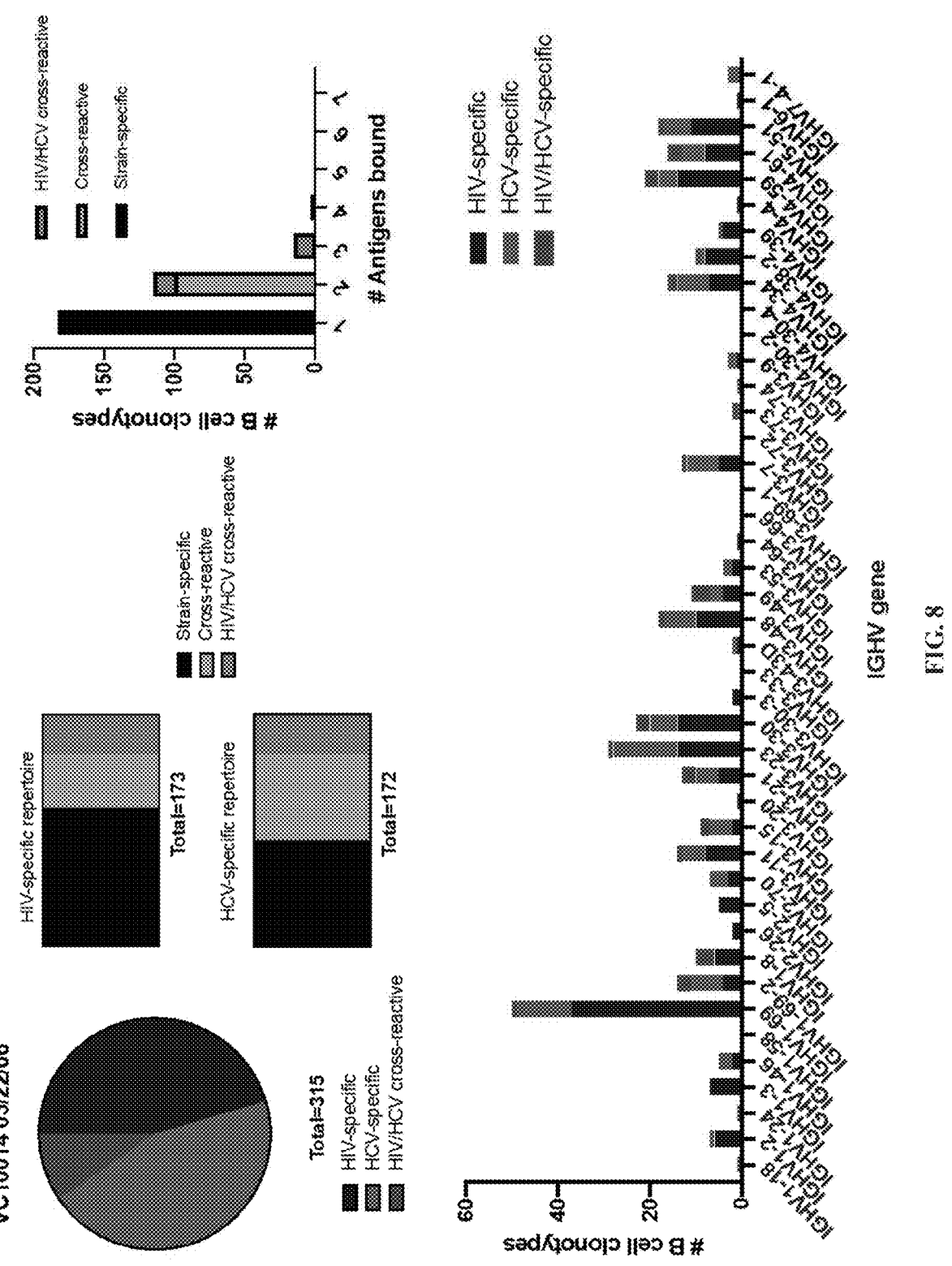
FIG. 8 shows that HIV/HCV cross-reactive antibodies make up ~9.5% of the data set.
Figure 8:
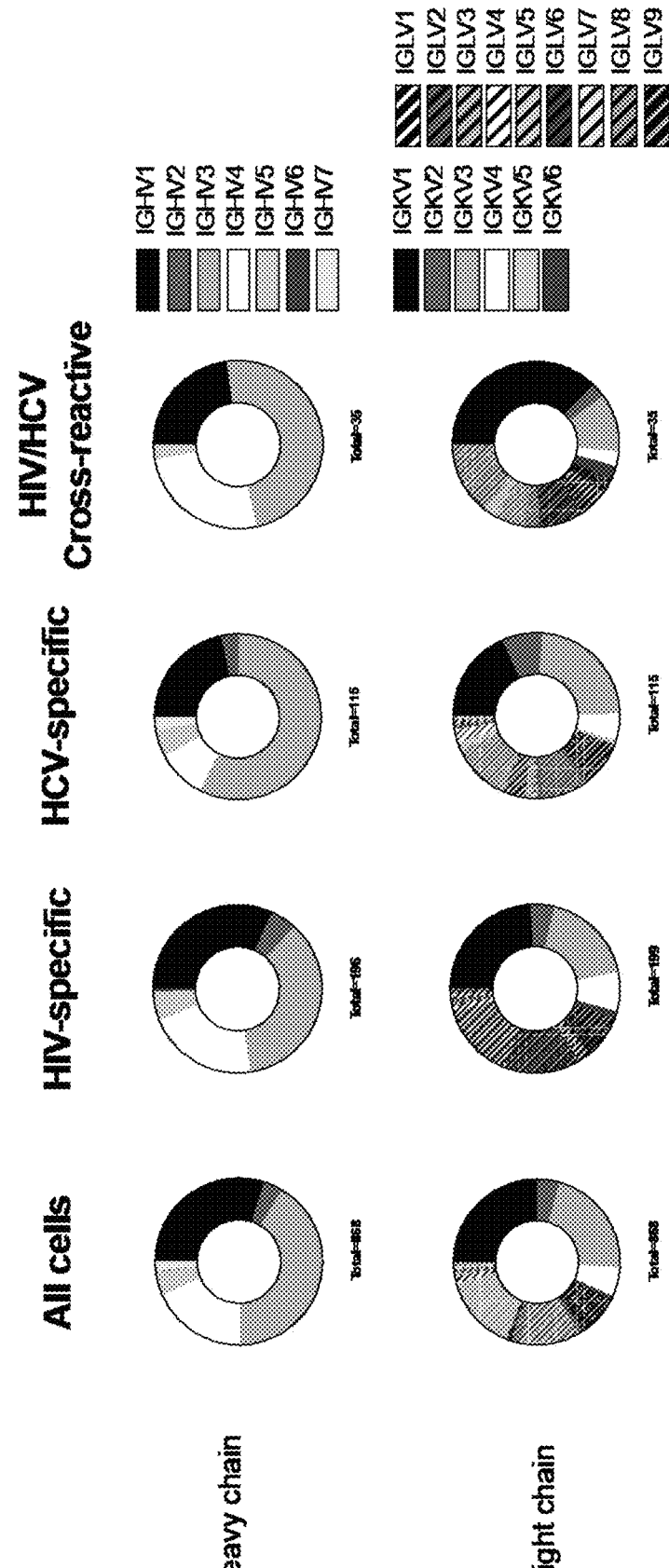
Figure 9:
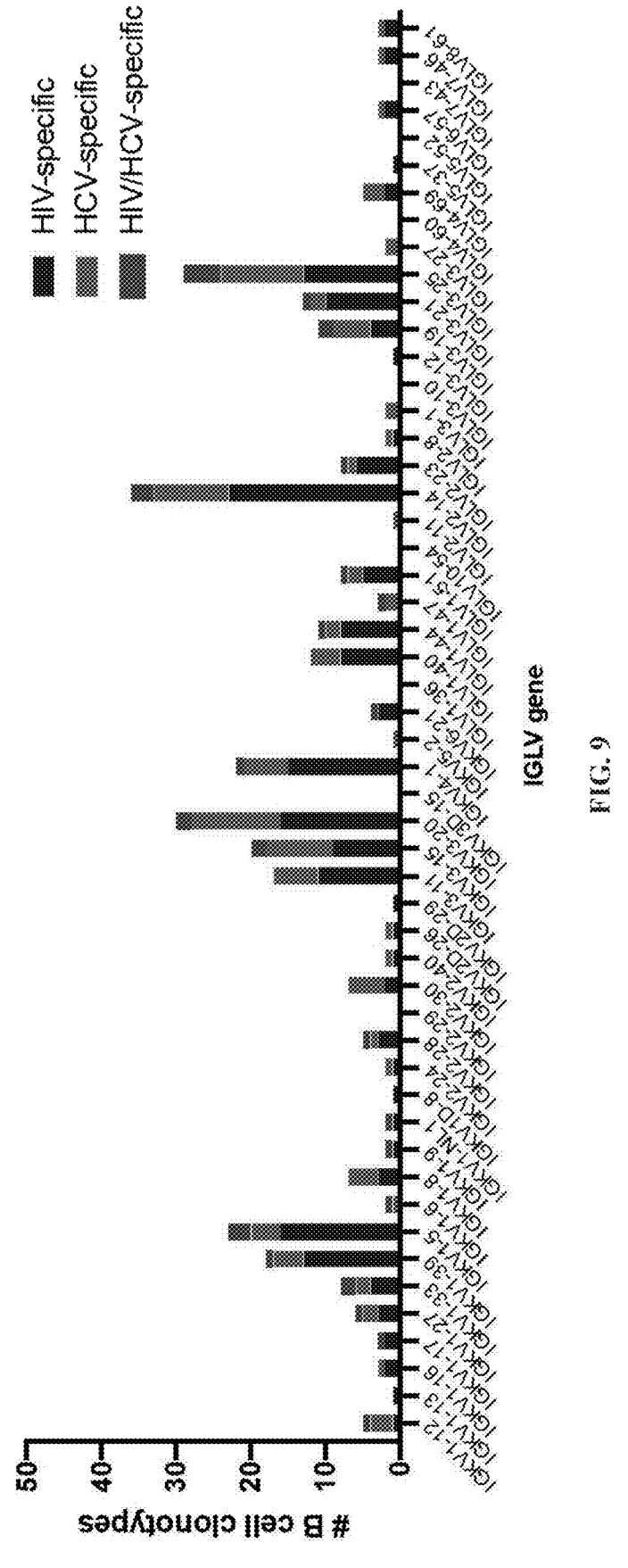
FIG. 9 shows that the LIBRA-seq data set uses diverse heavy and light chain variable genes.
Figure 10:
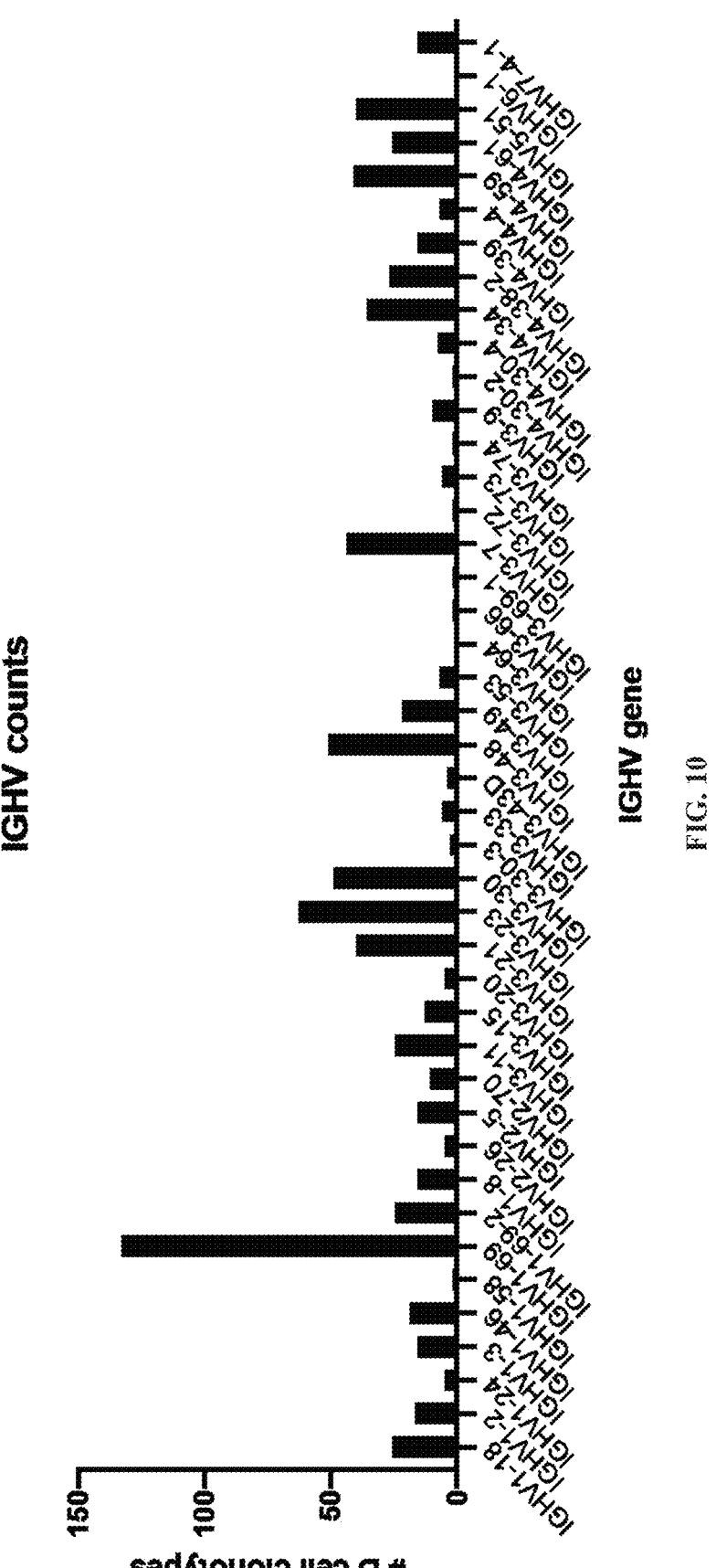
FIG. 10 shows that the LIBRA-seq data set uses diverse heavy chain variable genes (IGHV counts).
Figure 11:
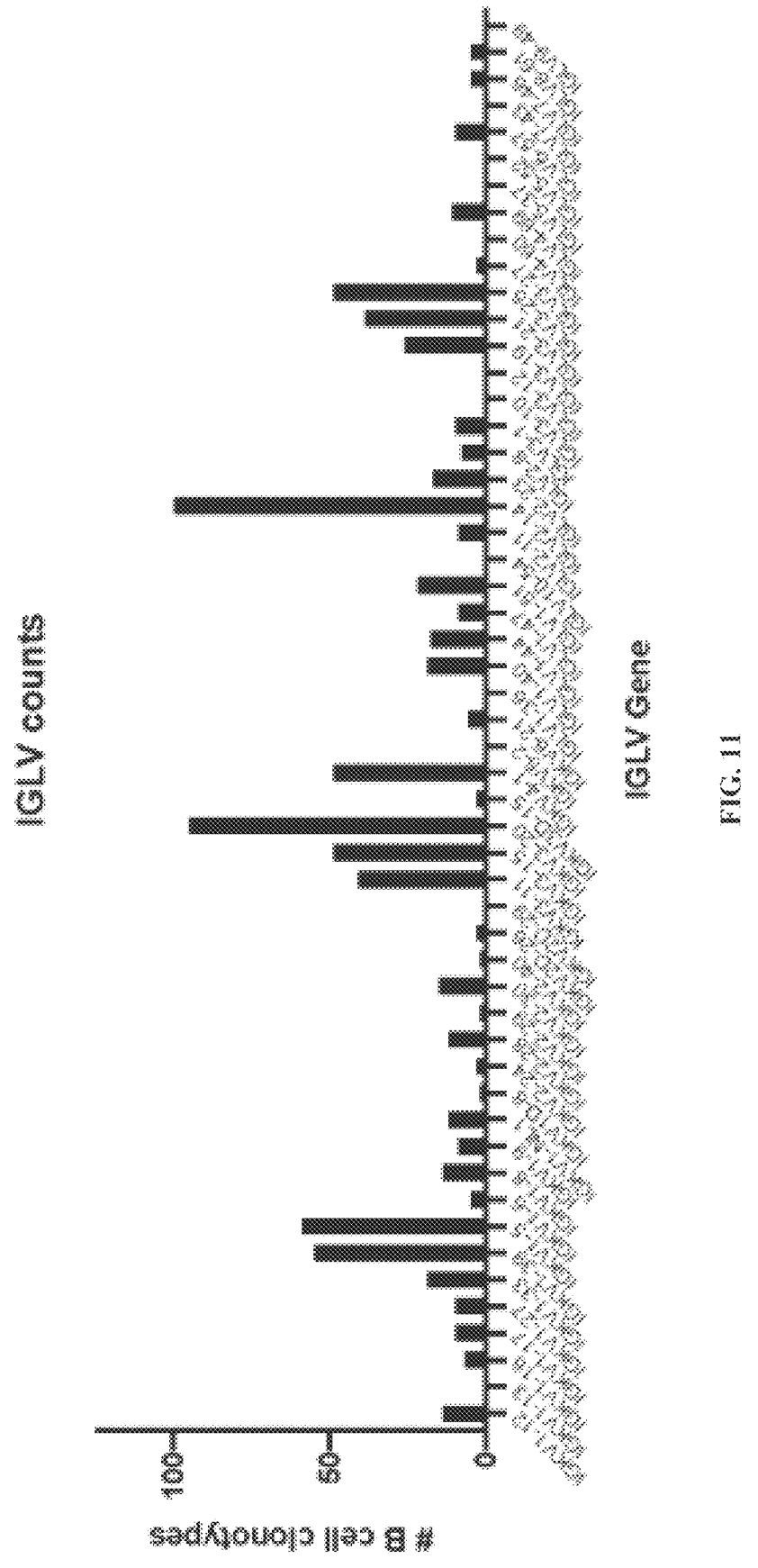
FIG. 11 shows that the LIBRA-seq data set uses diverse light chain variable genes (IGLV counts).
Figure 12:
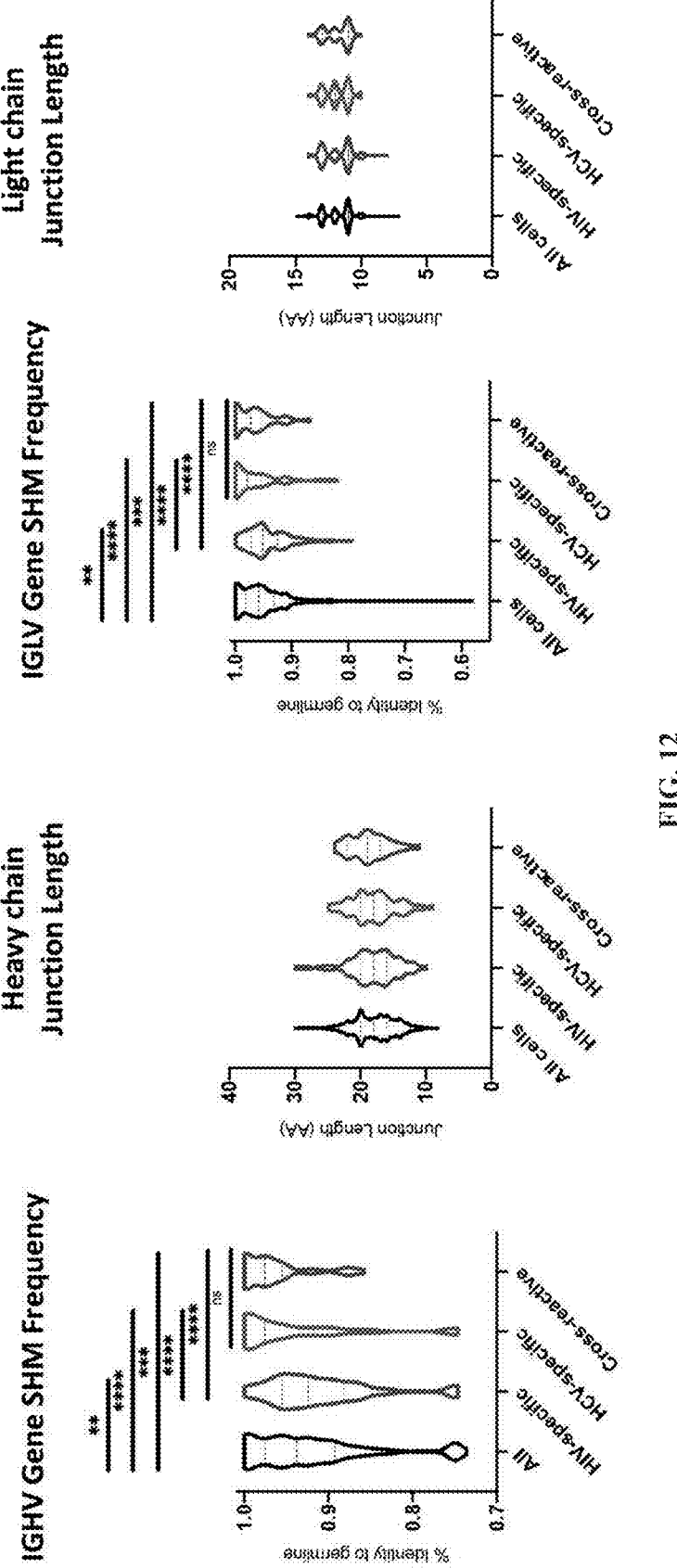
FIG. 12 shows that virus-specific antibodies have varying levels of somatic mutation.
Figure 13:
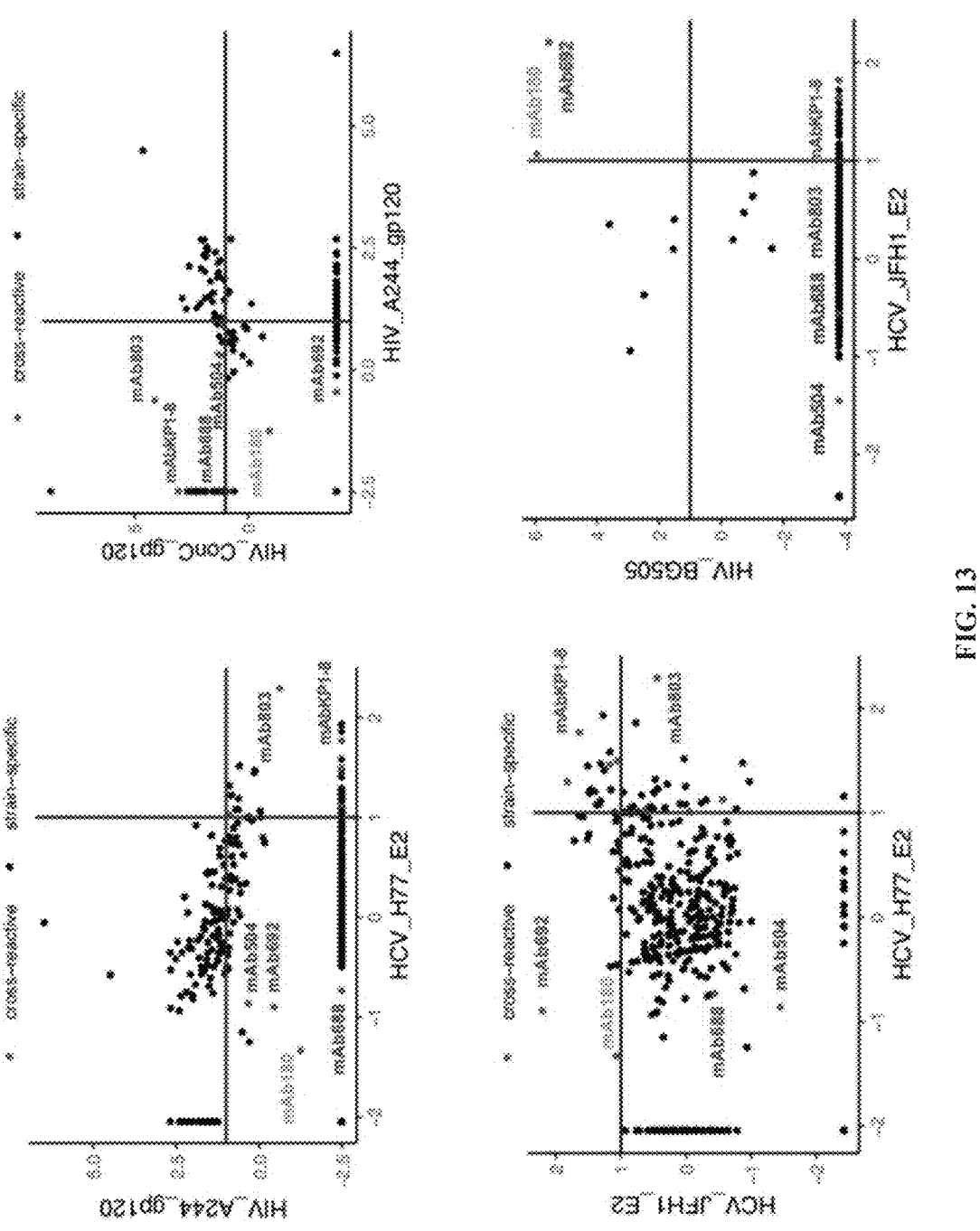
FIG. 13 shows HIV/HCV mAbs identified by high LIBRA-seq scores to HIV and HCV antigens. Each dot represents a single cell having the LIBRA-seq scores for the antigens shown on the x and y axes. HIV/HCV+ cells can be identified in quadrant I when plotting the LIBRA-seq scores for an HCV_and HIV_antigen shown by labeled dots.
Figure 13:
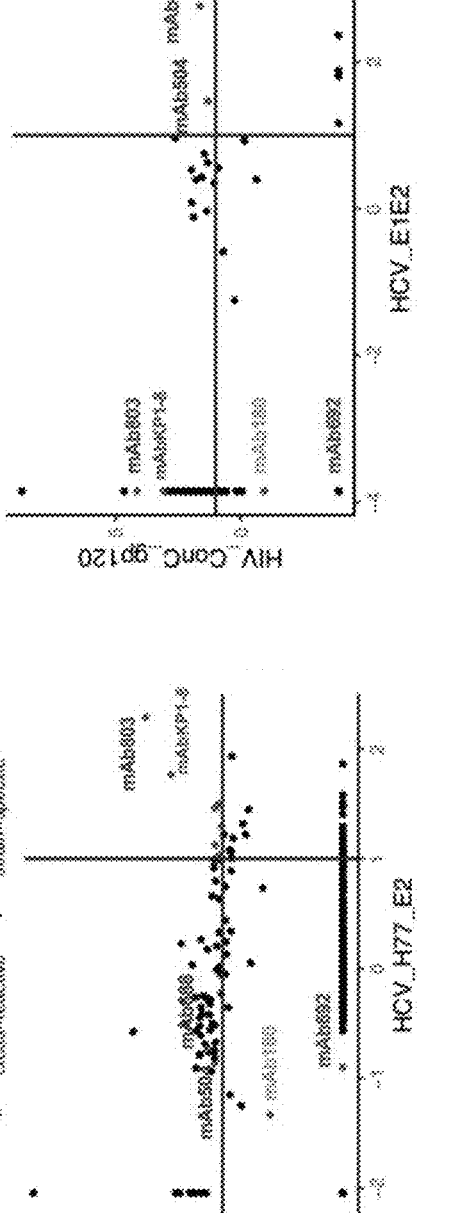
Figure 14:
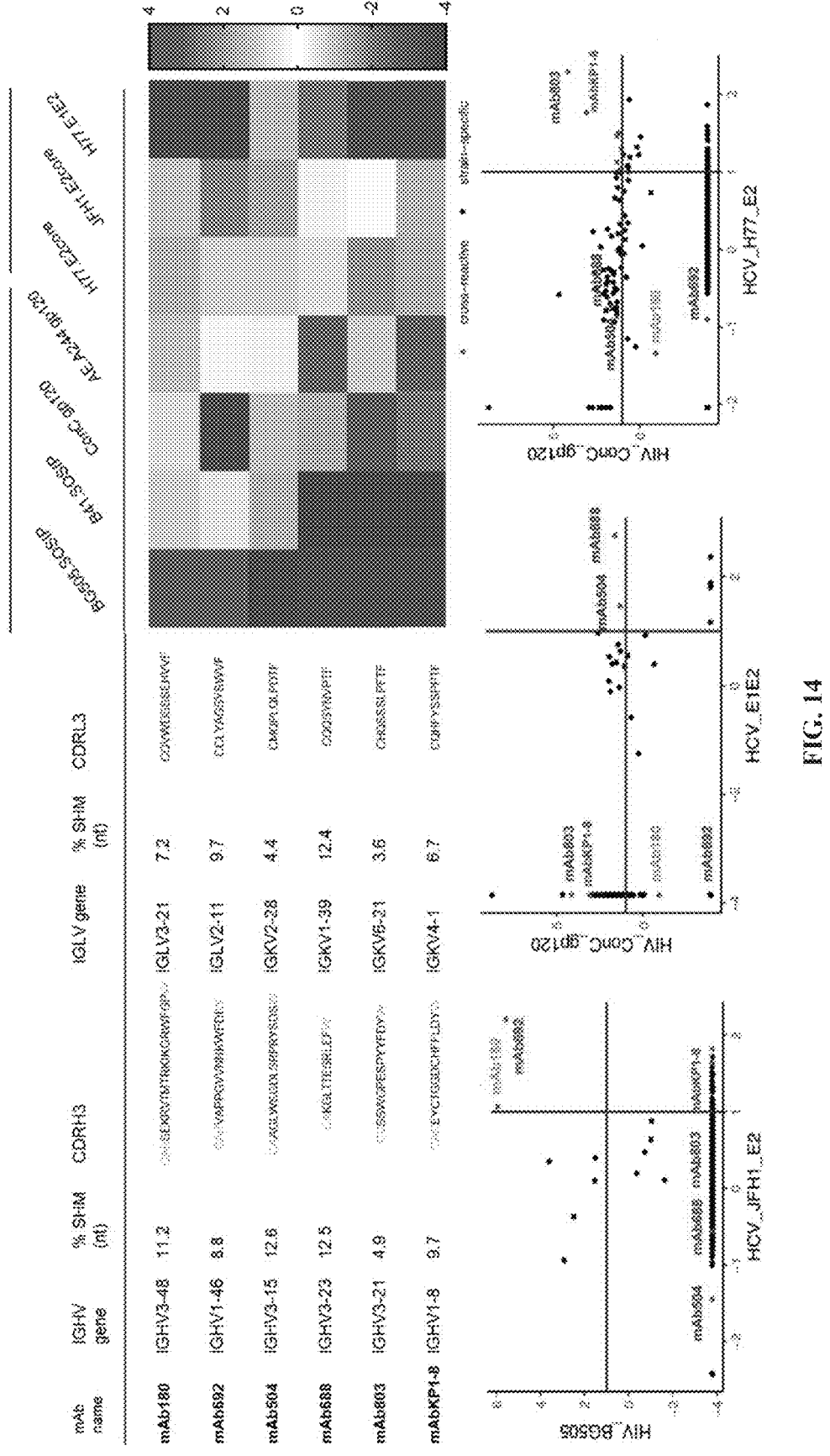
FIG. 14 shows genetic characteristics and LIBRA-seq scores for identified HIV/HCV mAbs (top). The LIBRA-seq scores for shown antigens are plotted against each other to identify HIV antigen and HCV antigen high cells (bottom). Sequences in FIG. 14: CARSEKRVTMTRKIKGRWFGPW (SEQ ID NO: 1822); CARVAPPGVVNNKWFDIW (SEQ ID NO: 1821); CAAGLWSGDLSRPRYSDSW (SEQ ID NO: 1817); CAKGLTTESRLEFW (SEQ ID NO: 1818); CVSSWGPESPYYFDYW (SEQ ID NO: 1819); CAREYC-TGGDCHFFLDYW (SEQ ID NO: 1820); CQVWDSSSEHVVF (SEQ ID NO: 1888); CCLYAGSYS-WVF (SEQ ID NO: 1887); CMQPLQLPDTF (SEQ ID NO: 1883); CQQSYNVPTF (SEQ ID NO: 1884); CHQSSSLPFTF (SEQ ID NO: 1885); CQHFYSSPPTF (SEQ ID NO: 1886).
Figure 15:
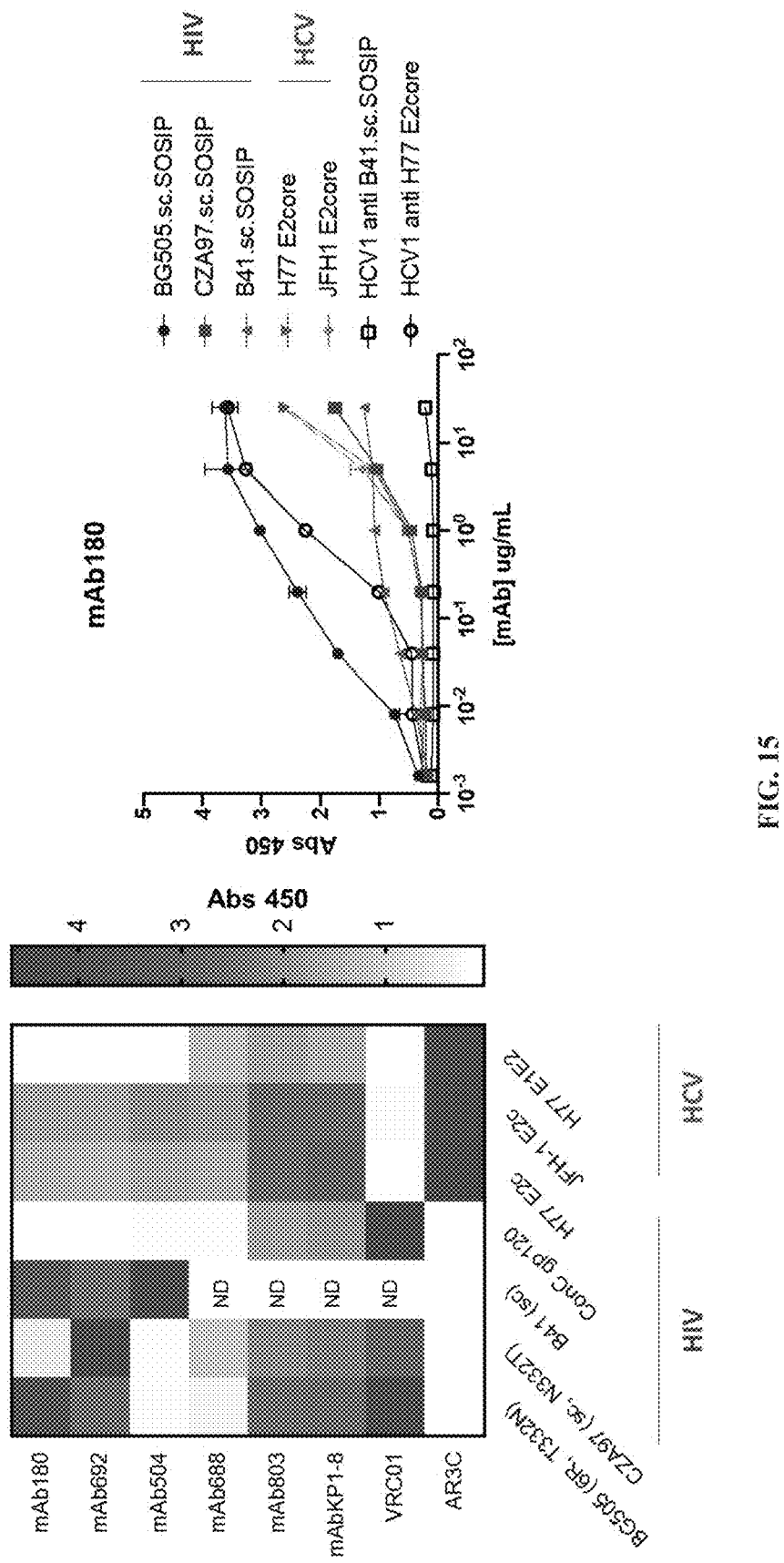
FIG. 15 shows recombinant expression confirms HIV/HCV cross-reactive binding.
Figure 16:
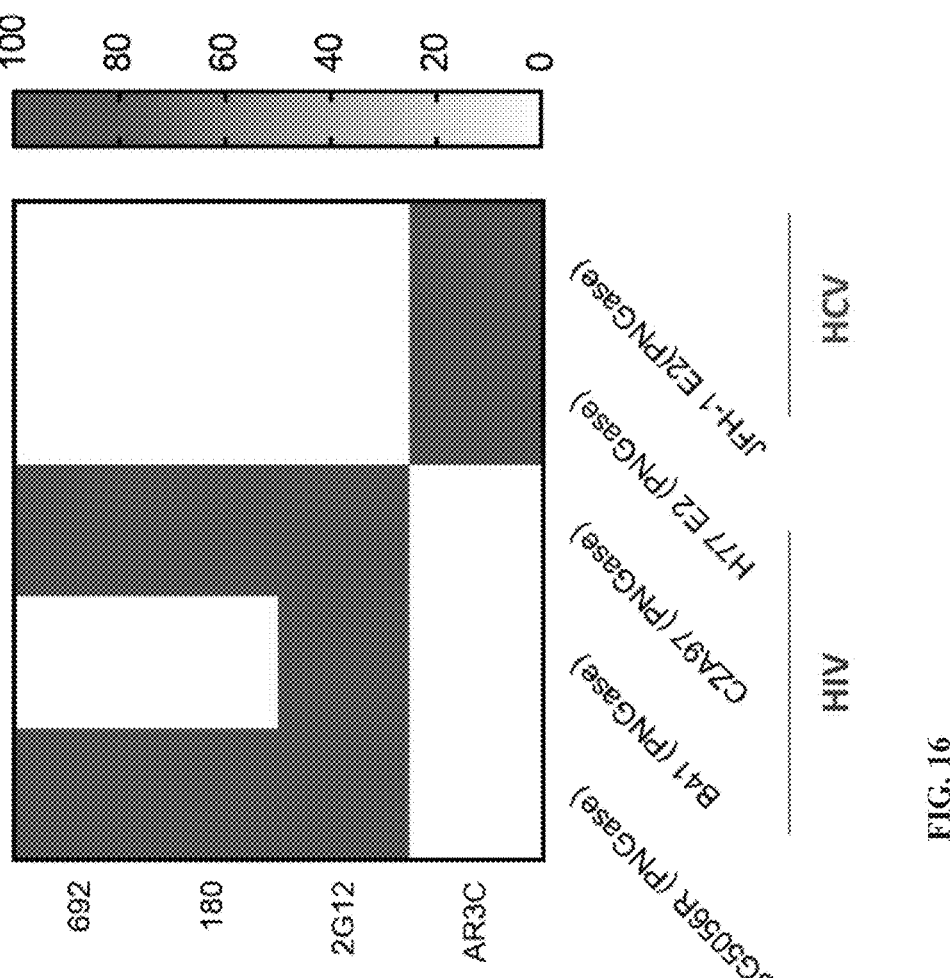
FIG. 16 depicts that HIV/HCV mAbs show strain-specific glycan dependence.
Figure 16:
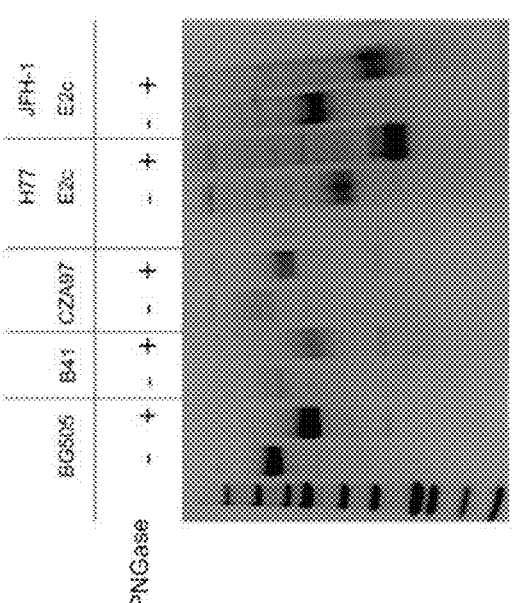
Figure 17:
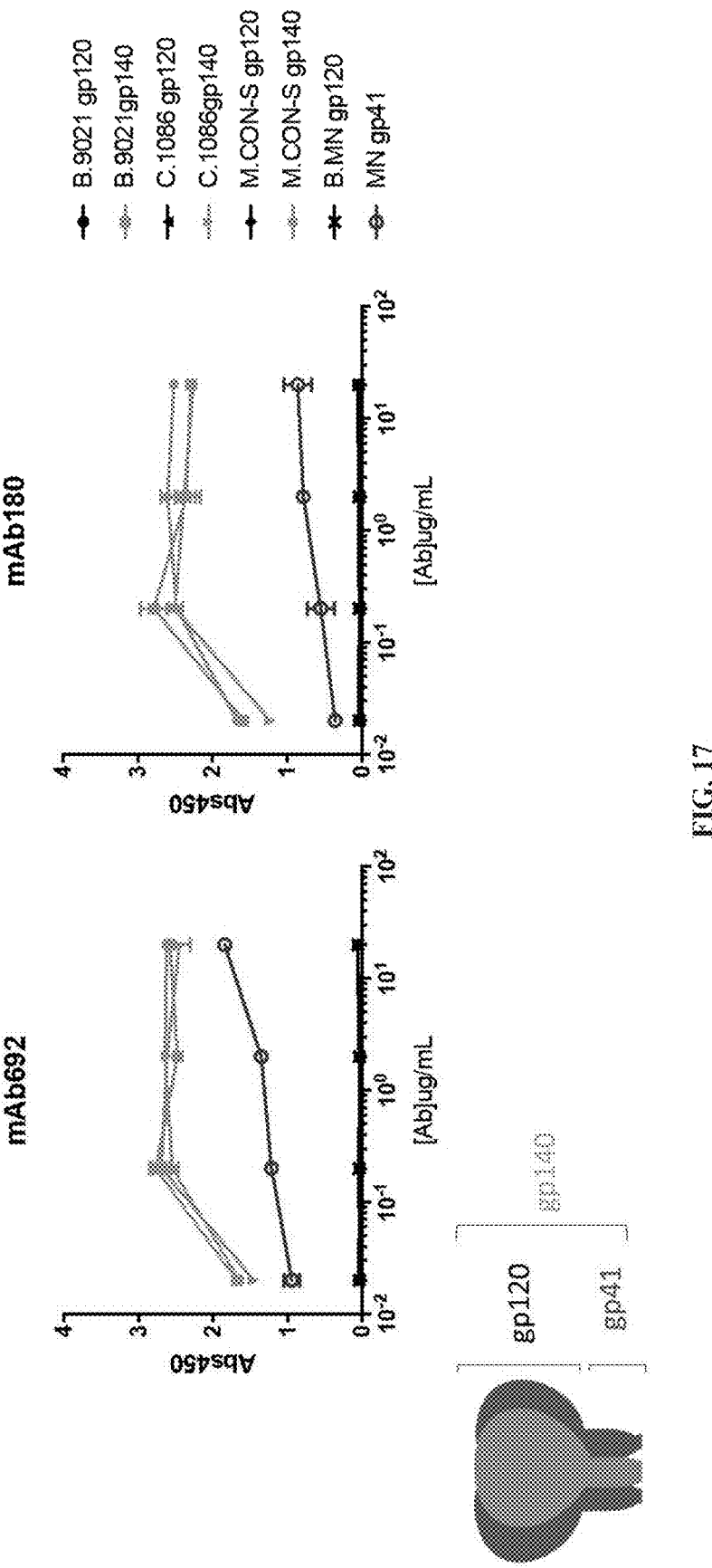
FIG. 17 shows that selected HIV/HCV cross-reactive mAbs are gp41-directed.
Figure 18:
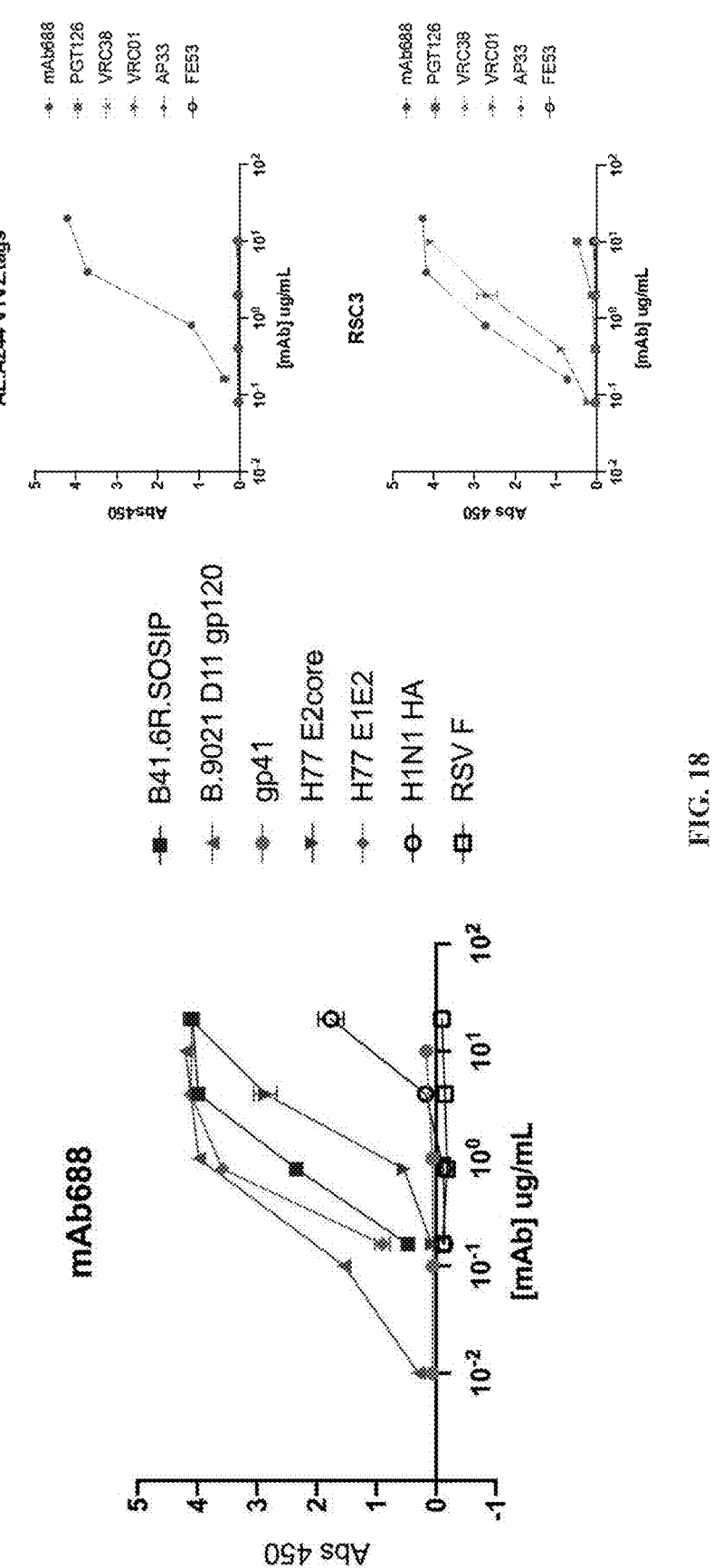
FIG. 18 shows that identified HIV/HCV cross-reactive antibodies can recognize multiple epitopes on HIV.
Figure 19:
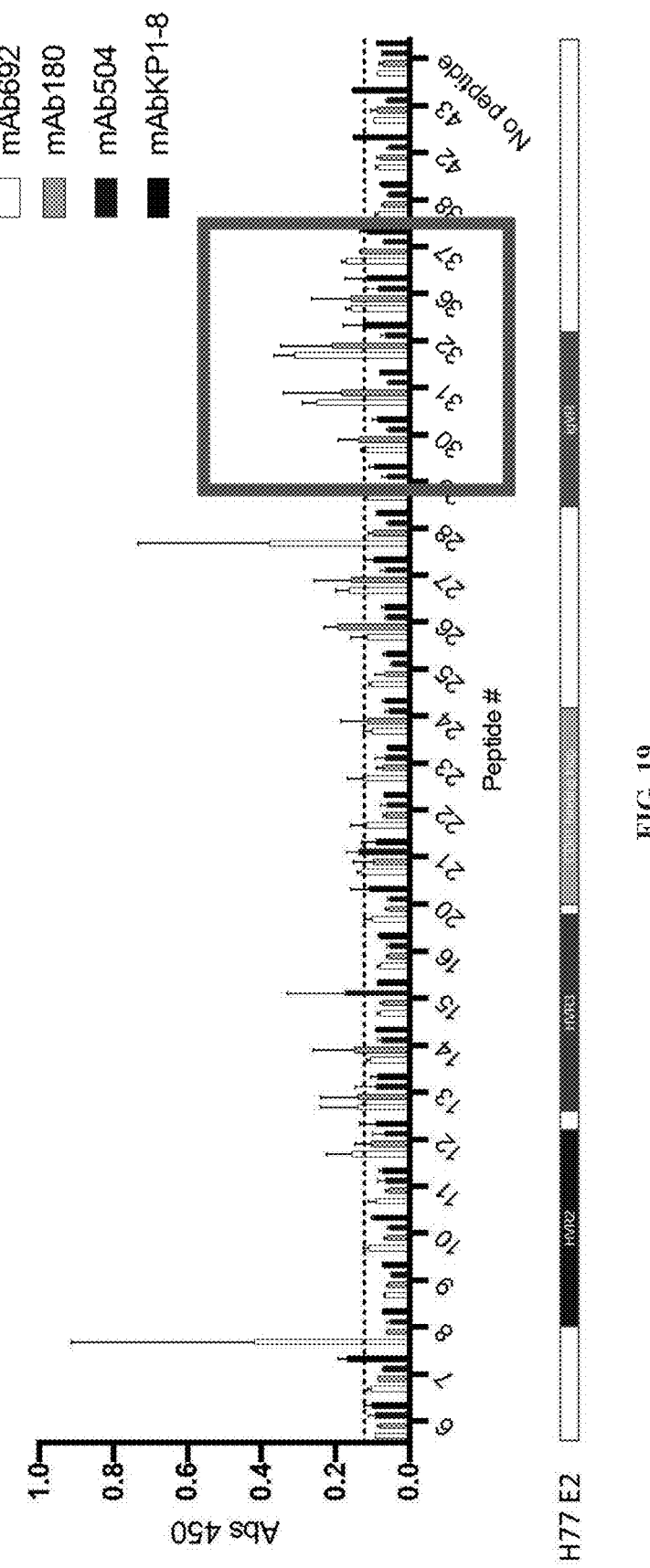
FIG. 19 shows that HIV/HCV cross-reactive mAbs recognize Antigenic Region 4.
Figure 20:
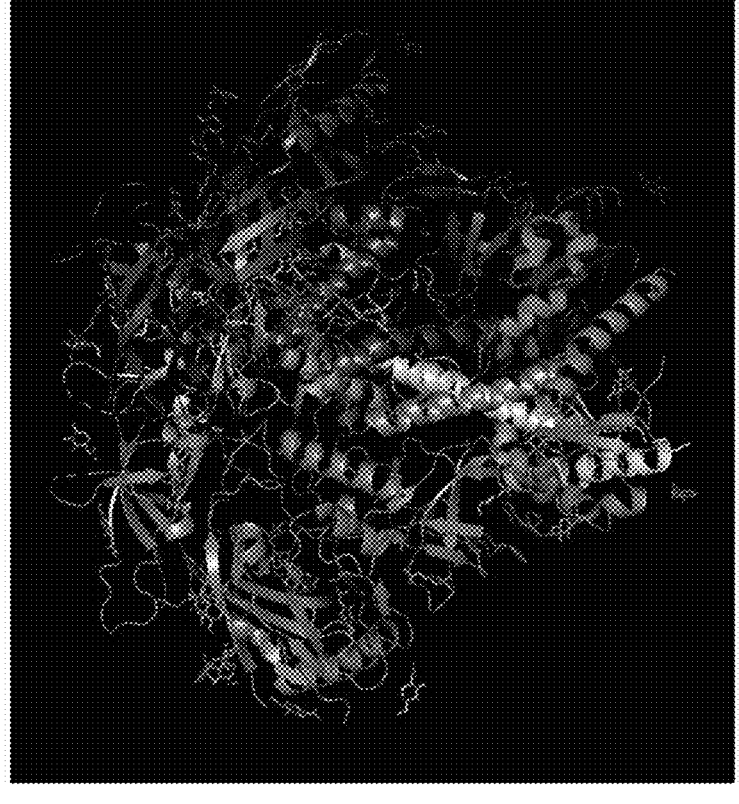
FIG. 20 shows predicted cross-reactive epitopes.
Figure 20:
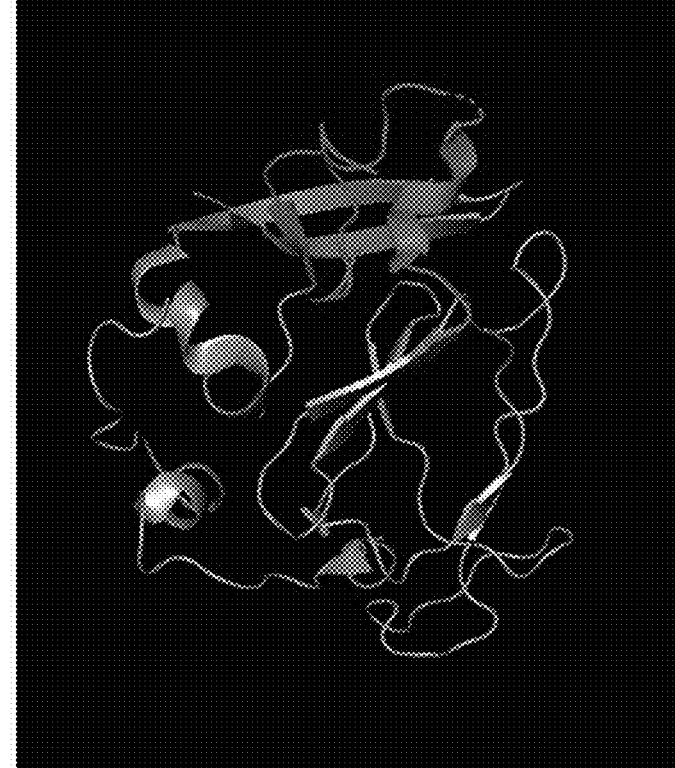
Figure 21:
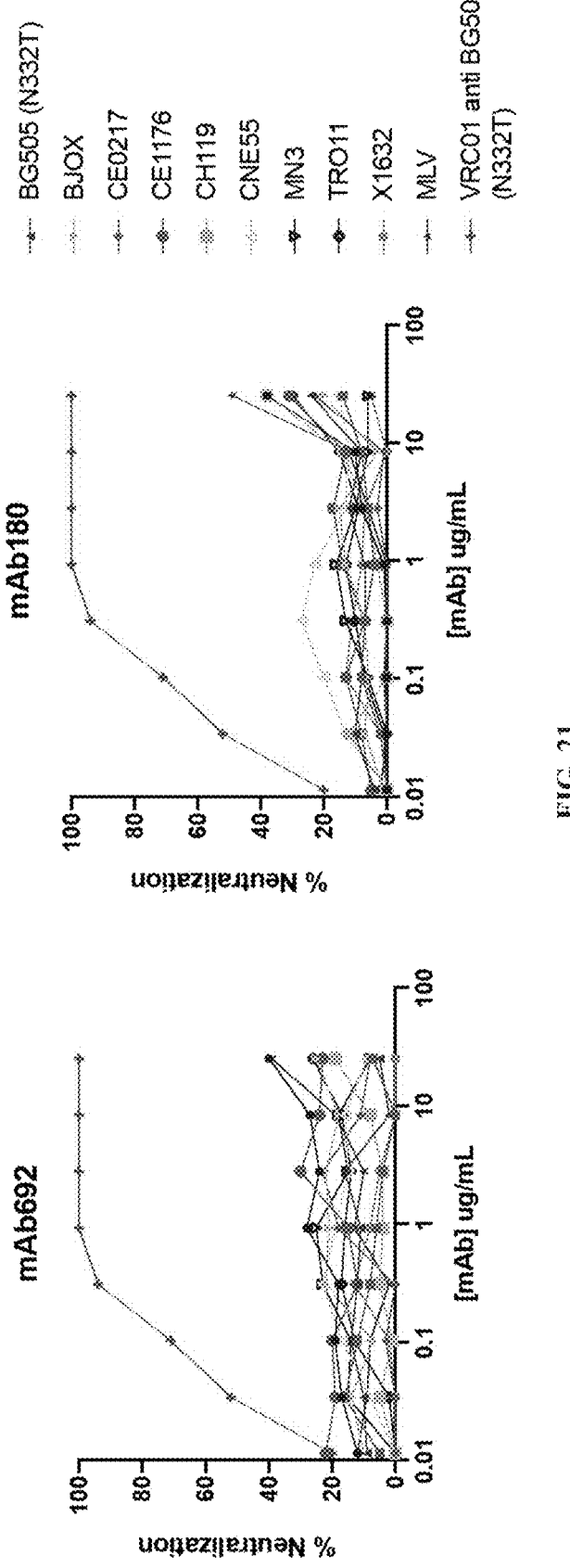
FIG. 21 shows that HIV/HCV cross-reactive mAbs are HIV non-neutralizing.
Figure 22:
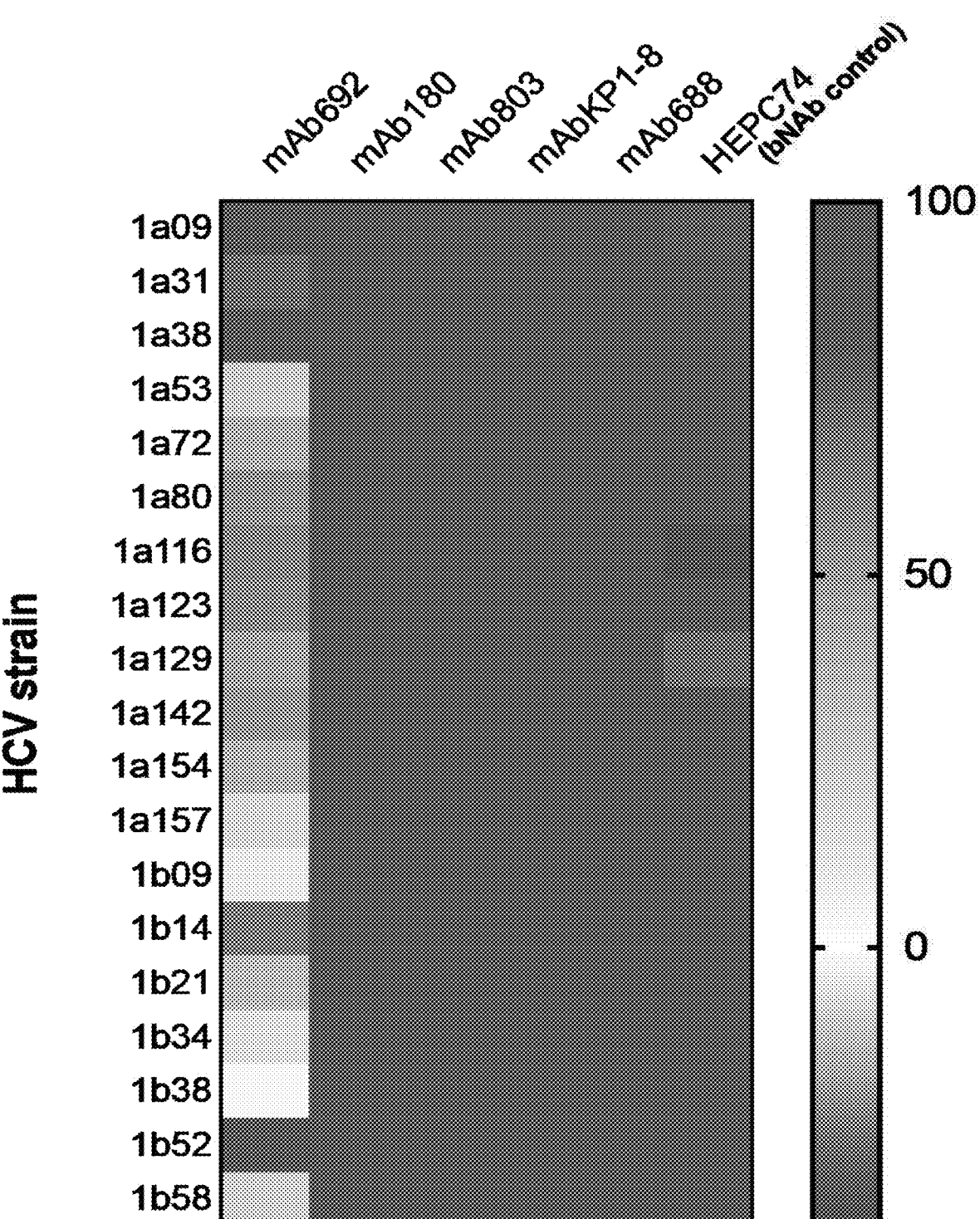
FIG. 22 shows that HIV/HCV cross-reactive mAbs show extraordinary neutralization breadth. HIV/HCV cross-reactive mAbs show superior neutralization breadth to HEPC74, previously the broadest neutralizing HCV antibody. The antibody was tested at 100 μg/ml.
Figure 23:
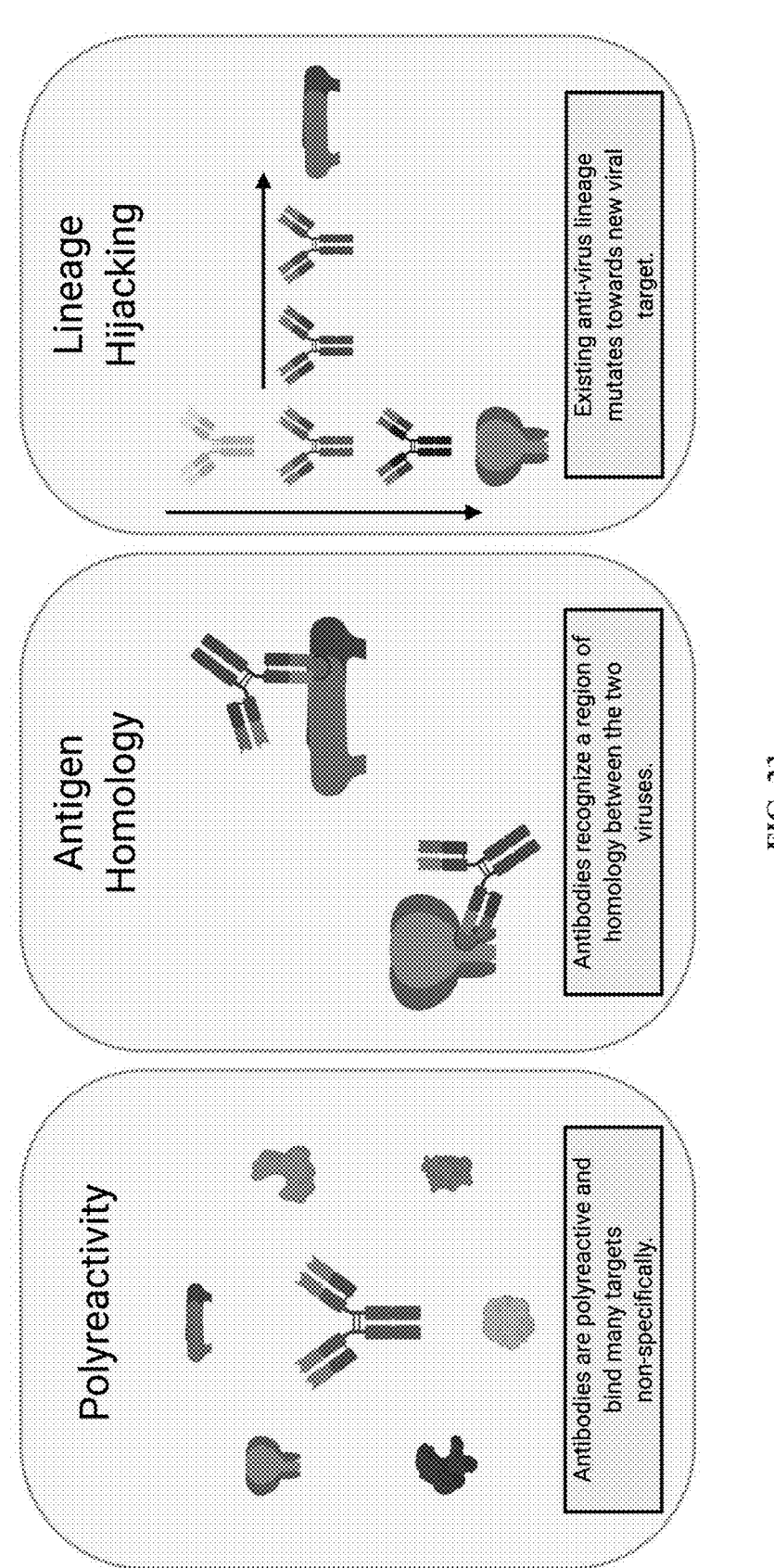
FIG. 23 shows how cross-reactivities can arise in HIV/HCV coinfection through polyreactivity, antigen homology, or lineage hijacking.
Figure 24A:
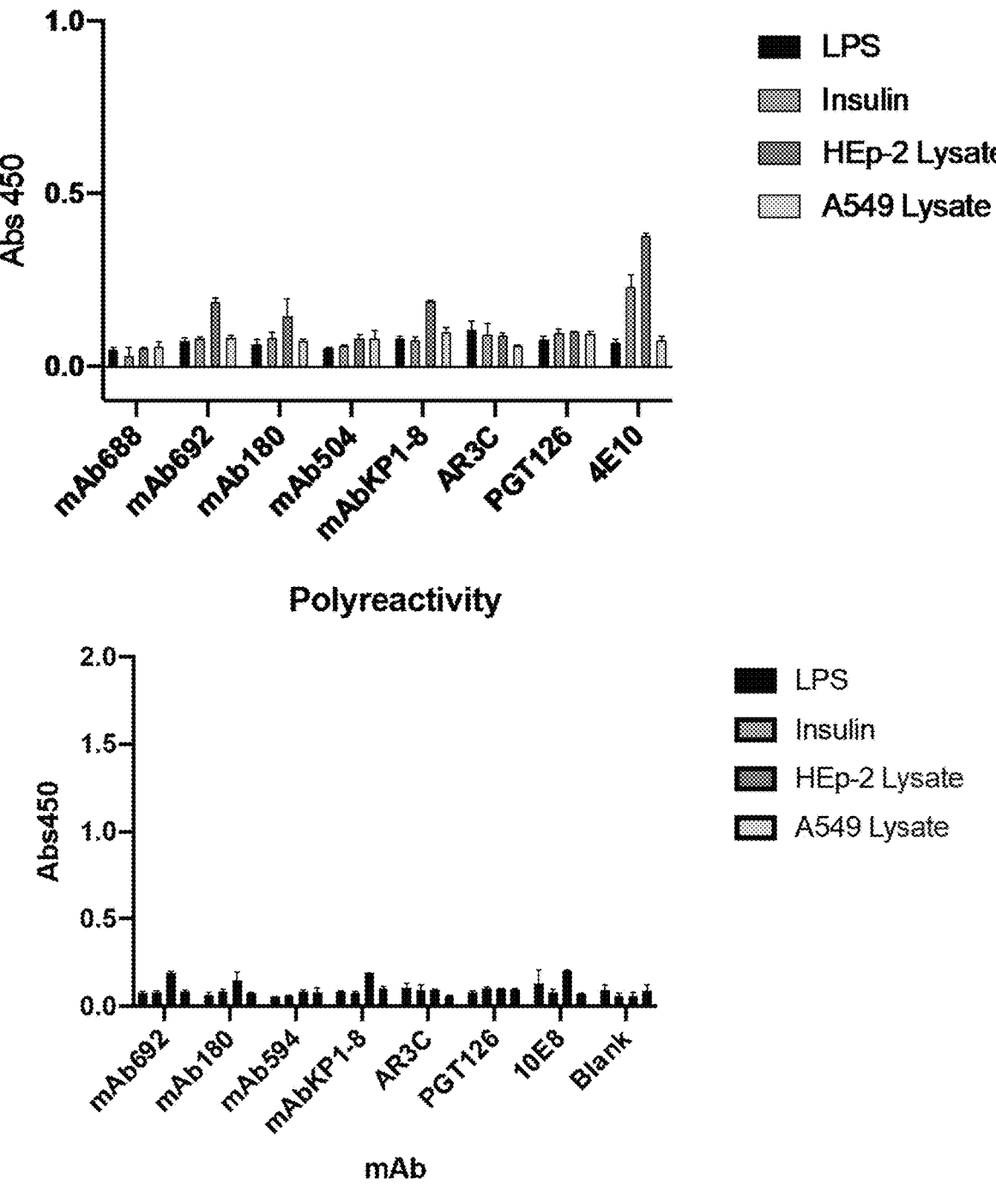
FIGS. 24A-24D depict that HIV/HCV cross-reactive mAbs show minimal polyreactivity.
Figure 24B:
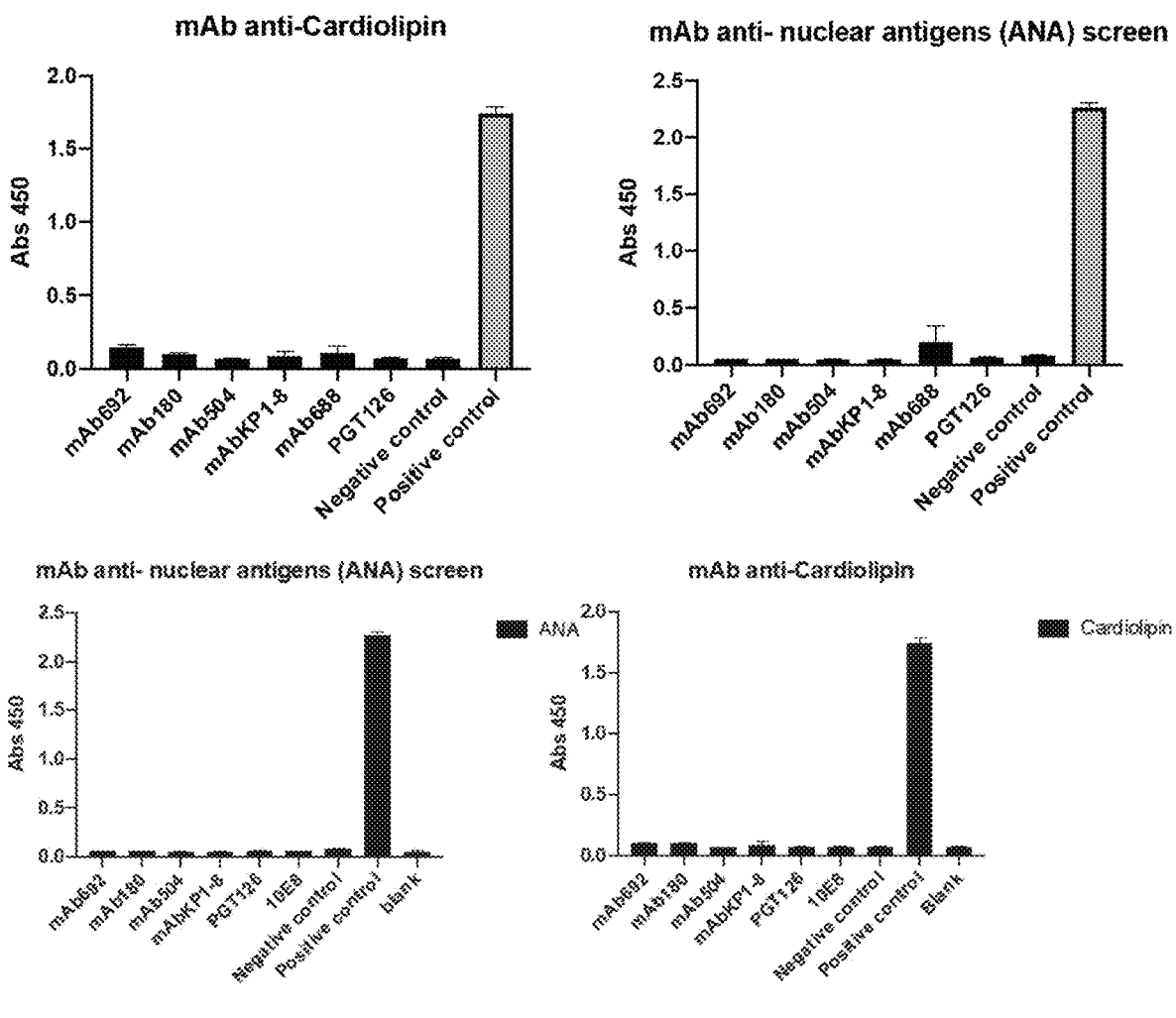
Figure 24C:
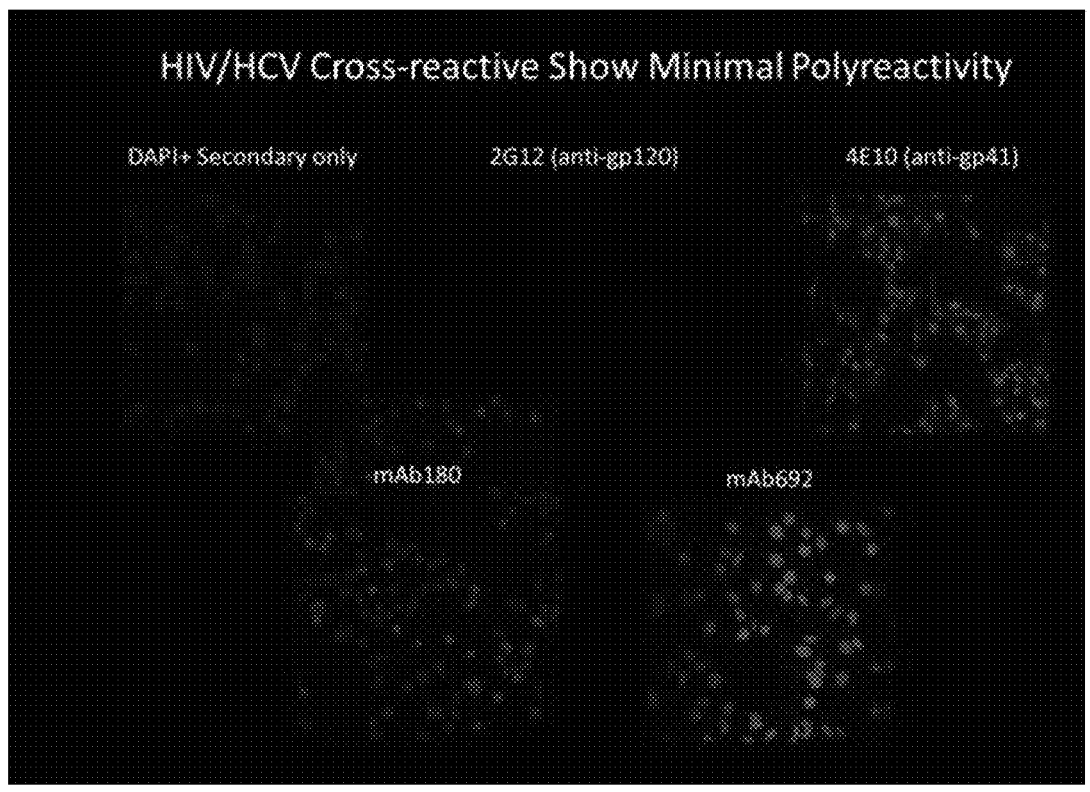
Figure 24D:
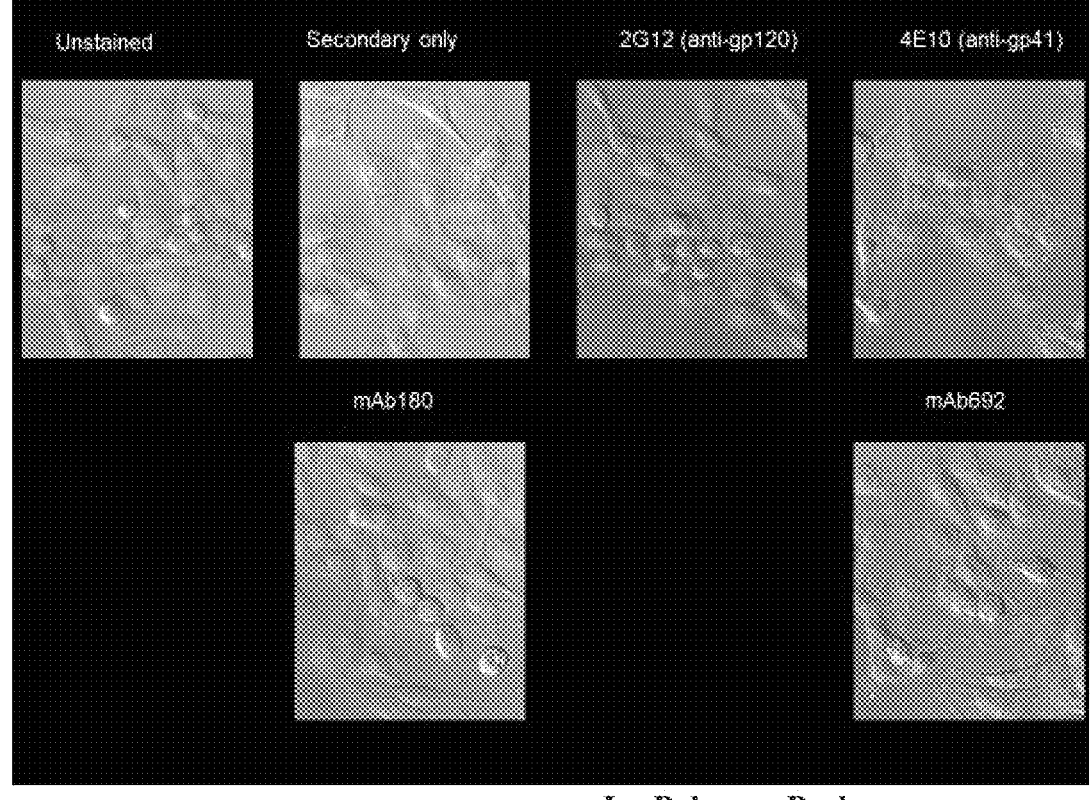
Figures 25, 26:
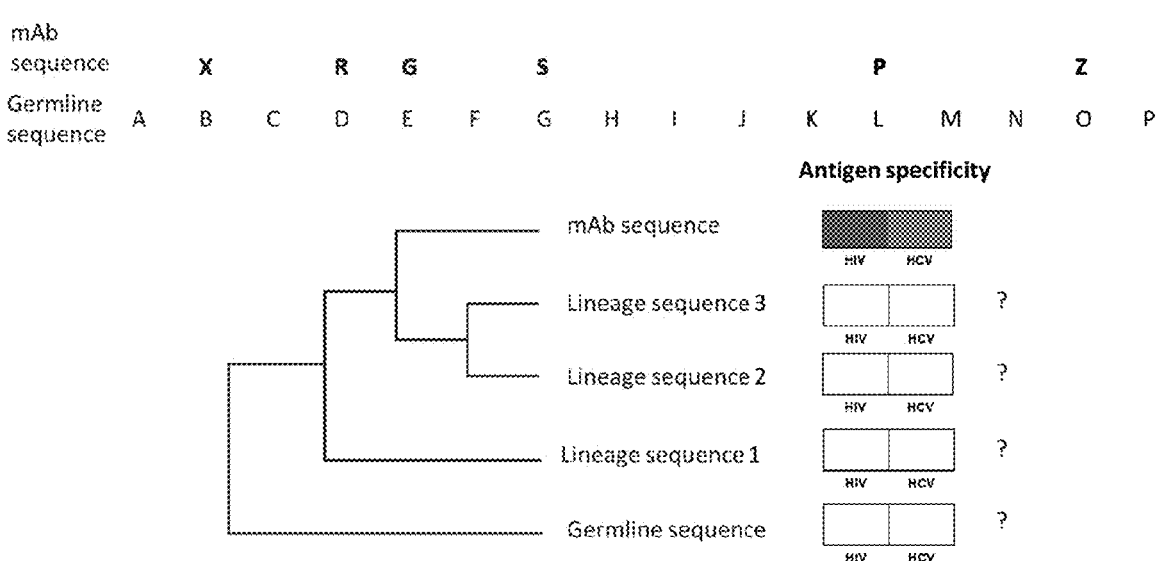
FIG. 25 shows tracing mutations and antigen specificity.
FIG. 26 shows that subsequent data was derived using a patient sample from a donor. Infection timepoints are shown. All antibody relative sequence data (not LIBRA-seq sequences) came from the Sep. 25, 2003 timepoint shown.

Samples were used from PTID: VC10014 (Vanderbilt cohort) taken 0.79 years post HIV infection (ypi) and 3.59ypi to isolate cross-reactive antibodies and begin characterizing their development using LIBRA-seq and unpaired deep sequencing (see approach). For LIBRA-seq a diverse panel of 4 HIV envelope glycoprotein antigens were used, each from a different viral clade (Clade A BG505 gp140 SOSIP, Clade B B41 gp140 SOSIP, Clade C ConC gp120 and recombinant circulating clade AE A244 gp120), and 3 HCV envelope antigens (Genotype 1a H77 E2 and E1E2, genotype 2a JFH-1 E2). Each antigen was labeled with a unique 15 nucleotide barcode and used to identify multiple, class-switched HIV/HCV cross-reactive B cells from the 3.39 ypi timepoint (FIG. 1). Expression of identified B cell receptors as recombinant antibodies confirmed their cross-reactivity against both HIV and HCV antigens. To trace the early development of identified HIV/HCV cross-reactive antibodies, PBMCs from 0.79ypi were sequenced and their maturations were inferred using phylogenetic analyses (FIG. 2). Taken together, these data demonstrate the identification of rare, HIV/HCV cross-reactive antibodies from a chronically co-infected cohort donor.

Example 2. Identifying Antibodies Recognizing HIV/HCV Co-Infection

A variety of techniques are utilized, including antigen-specific B-cell sorting, next-generation sequencing of antibody repertoires, and monoclonal antibody (mAb) functional validation assays.

The first step is performing antigen-specific B-cell sorting for two timepoints for each individual, which leads to the identification of antibodies that are reactive with each antigen. This step results in paired heavy/light chain sequences for antigen-specific antibodies against HIV and/or HCV. The next step is performing "deep" sequencing of the antibody repertoires for each timepoint, which allows the tracing of the lineage evolution for the antibodies identified in the antigen-specific sort (step 1). This step results in non-paired heavy and light chain sequences, but at a substantially greater sequencing depth than what is obtained in step 1. Clonal relative antibody sequences are expressed as recombinant antibodies to assess the effect of acquired somatic mutations over the course of chronic HIV/HCV co-infection on antigen specificity.

Example 3. Identifying Antigen-Specific Antibodies Using LIBRA-Seq in Co-Infected Individuals Samples are analyzed using a technology termed LIBRA-seq. This technology leverages DNA-barcoded antigens and a combination of antigen-specific B-cell sorting and single cell sequencing. After sequencing, antigen-specificity can be assigned to each single cell, along with B cell receptor sequence information, by mapping frequency of each antigen barcode. Further discussion of materials and methods for LIBRA-seq and for identifying paired heavy-light chain BCR sequences can also be found in WO2020033164, which is herein incorporated by reference in its entirety. For additional materials and methods, see WO2019/143884, which is herein incorporated by reference in its entirety.

Selection of antigen probes for sorting. The antigens that are used are forms of the Env glycoprotein from HIV-1 and the E1E2 glycoprotein from HCV, which have been identified as targets for neutralizing antibodies. A cocktail of antigen variants are used for each of HIV Env and HCV E1E2. The Env variants include trimeric gp140 stabilized in the closed prefusion conformation, and non-stabilized gp140, gp120, as well as MPER peptide; these constructs are in at least two different strain backgrounds (clade-A BG505 and clade-B B41). The HCV variants include E2 core as well as E1E2 heterodimer, from at least three strains (H77 [genotype 1a], J1 [genotype 2a], and HIC-109 [genotype 3a]). For HIV, all antigen variants are labeled with the same single color; similarly, all HCV antigen variants are labeled with the same single color (that is different from the HIV antigen color). About ten HIV and ten HCV antigens are used for sorting. The goal of including multiple different variants (a cocktail of antigens) for each pathogen is to capture a wider range of antigen-specific antibodies, in order to increase the amount of information obtained for the antigen-specific antibody repertoires. Using multiple antigen variants from multiple strains from each of the two pathogens also increases the chances of identifying antibodies with cross-reactivity between the two pathogens.

Antigen production. Recombinant soluble avi-tagged antigens are expressed in 293F or EXPI293™ mammalian cells using polyethylenimine (PEI) transfection reagent, and incubation for 5-7 days. Protein antigens are purified over an affinity column of agarose bound *Galanthus nivalis* lectin (Vector Laboratories cat no. AL-1243-5) at 4° C. Concentrated proteins are run on a SUPERDEX™ 200 Increase 10/300 GL or SUPEROSE™ 6 Increase 10/300 GL sizing column on an AKTA™ FPLC system. Fractions corresponding to correctly folded antigen are analyzed by SDS-PAGE, and antigenicity by ELISA is characterized with known mAbs specific for that antigen. Purified antigen proteins are biotinylated using BirA biotin ligase and conjugated to streptavidin-APC or streptavidin-PE for use in flow cytometry. Unique oligonucleotide barcodes are directly conjugated to each antigen using the SOLULINK® Protein-Oligonucleotide Conjugation Kit (TriLink cat no. S-9011) according to manufacturer's instructions. Antigen concentrations are estimated by BCA assay.

Antigen-specific B-cell sorting. PBMCs from the co-infected donors are stained with a panel of positive and negative cell markers to identify memory B cells, and with fluorescent antigen to identify virus-specific B cells. B cells are gated as CD3-CD14-IgM-IgG+CD19+ and antigen+. Both single virus and double virus-specific cells are sorted into complete RPMI for subsequent single cell sequencing.

Antibody sequence determination. Cells are bulk sorted for loading onto the CHROMIUM™ microfluidics device (10X Genomics) and processed using the B-cell VDJ solution according to manufacturer's instructions for a target capture of 10,000 B cells per ⅛ 10X cassette. Positive control cell lines (such as the VRC01 Ramon B cell line) can be spiked in to meet the 10X-recommended cell counts and to also provide an idea of efficacy and recovery. Briefly, B-cell populations of interest are sorted into complete RPMI (RPMI 1640+10% FBS) at a concentration of 300 cells/µL. Immediately after sorting, cells are pelleted for 5 minutes at 300×g using an ACCUSPIN™ Micro17 table-top centrifuge. The pellet is re-suspended in complete RPMI to 800-1200 cells/µL at a viability >90%. For library preparation, cells are partitioned into oil emulsions using a microfluidic circuit, enforcing one cell per reaction mixture. Upon lysis, NGS oligo adaptor sequences present on the oil emulsions capture messenger RNA from each cell. Following PCR amplification, V (D) J genes are further enhanced by targeted enrichment. The resulting cDNA is purified, and BCR and antigen barcode libraries are separated based on amplicon size. Resulting libraries are sequenced using the NOVASEQ 6000™ instrument, each donor sample run through the 10X technology is prepped separately and placed on separate lanes of a flow cell. Output fastq files are processed using Cell Ranger (10X Genomics) to assemble, quantify, and annotate paired V (D) J transcript sequences and antigen barcode counts on a cell-by-cell basis using 10X CHROMIUM™ cellular barcodes.

LIBRA-seq score determination. To define antigen-specificity, each cell is assigned a LIBRA-seq score for each antigen. This score is calculated by counting the number of antigen barcodes for each cell and calculating the centered-log ratio (CLR). Because the scale of counts for each antigen can differ, due to differential oligo loading during oligo-antigen conjugation, the CLR counts are rescaled using the StandardScaler method in scikit learn. This transformed and scaled number is defined as the LIBRA-seq score, which can then be used to compare antigen specificity across cell samples.

Example 4. Investigation of Antibodies from HIV/HCV Co-Infected Donors Using Non-Paired-Chain Antibody Sequencing The antigen-specific antibody sequence determination described above can result in sequence information for up to tens of thousands of B cells. As these are the first reported antibodies able to recognize diverse unrelated viruses, it is also important to understand how these complex specificities develop. To accomplish this, bulk non-paired heavy and light chain sequencing is performed for at least two timepoints for both donors (with no antigen-specific sorting), which results in millions of sequences per sample. Then, by matching clonal relatives from both the paired and non-paired sequencing datasets from multiple timepoints, the evolution of antigen-specific antibody lineages can be tracked at a substantially greater resolution.

PBMC samples are prepared for ILLUMINA™ sequencing using the ILLUMINA™ NEXTERA™ library preparation protocol. Whole cellular RNA is extracted using the RNEASY® kit (Qiagen), and reverse transcribed into cDNA using 5' RACE. The library is then amplified by several rounds of PCR, to include unique molecular identifiers (UMIs) and sequenced on an ILLUMINA™ HISEQ™ instrument, resulting in ~150 million reads/library. Library preparation is performed essentially as in Turchaninova, M. A. et al., 2016. Output FASTQ files from ILLUMINA™ sequencer are preprocessed using pRESTO. The PhyML is used to build and trace antibody lineages from the next-generation sequencing data.

Example 5. Development of Antibodies from HIV/HCV Co-Infected Donors mAbs are selected for further characterization to confirm their antigen specificity and function. The antibodies are characterized in various assays, including antigen binding, virus neutralization, and epitope mapping. These assessments provide insights into the functional role of the identified antigen-specific antibodies. Clonal relatives of these mAbs are selected for experimental validation to test the effect of acquired mutations in both the heavy and light chain sequences on antigen-specificity. For each donor, up to 5 HIV/HCV cross-reactive antibody lineages are selected, with up to three antibody representatives from each lineage for characterization. mAbs are characterized in various functional assays. These assays show the antigen specificity of the target antibodies, and also provide insights into how antibody affinity maturation contributes to acquired anti-pathogen functions.

mAb production. Selected antibody sequences are cloned custom expression vectors containing the heavy chain, kappa chain, or lambda chain signal sequence and constant region (Twist Bioscience). EXPI293™ cells are co-transfected with plasmids expressing matched pairs of heavy and light chain genes. Recombinant antibodies are purified on a protein A affinity column. Finally, antibodies are purified using a SUPERDEX™ 200 Increase 10/300 GL or SUPEROSE™ 6 Increase 10/300 GL sizing column on an AKTA™ FPLC system.

Binding assays. Standard ELISA techniques are used to measure binding of each isolated mAb to a representative panel of envelope proteins from various clades and genotypes. 2 µg/mL of each envelope glycoprotein construct is plated overnight on NUNC™ Immuno plates followed by blocking, and incubation with threefold serial dilutions of primary antibody starting at 20 µg/mL. Binding is detected by HRP-conjugated anti-human IgG secondary. Data are reported as absorbance at 450 nm.

The identification of HIV/HCV cross-reactive antibodies represents the identification of the first antibodies that cross-react with genetically unrelated viruses. Several mechanisms can explain antibody cross-reactivity between unrelated antigens. For examples, these cross-reactive antibodies can recognize epitopes of low-level structural similarity on the HIV and HCV envelope antigens (with low affinity for either antigen); or distinct antibody paratopes can utilize differential modes of binding to recognize each of the antigens. Furthermore, pre-existing memory B cells specific for a given antigen (e.g., HCV E2) can re-enter the developing antibody response against a new pathogen (e.g., HIV), a phenomenon that has been observed in other disease settings (e.g., malaria). A cross-reactive antibody lineage that was discovered at an early timepoint can evolve separate branches that gain increased specificity for one, and decreased specificity for the other, antigen.

Example 6. Diversion or Double-Edged Sword: Antibody Cross-Reactivity in HIV/HCV Co-Infection Investigating the human antibody response to HIV and HCV has led to significant advances towards preventative therapeutics and vaccines against these highly mutable pathogens. Yet, despite the high prevalence of HIV/HCV co-infection, little is known about antibody responses in this context. To address this deficit, the effect of chronic co-infection with HIV and HCV on the development of virus-specific humoral responses were investigated. To investigate this, LIBRA-seq (Linking B cell Receptor to Antigen specificity by Sequencing) was used, which is a technology recently developed that uses DNA-barcoded antigens to map B cell specificity through single-cell next-generation sequencing. Class-switched B cells that recognize viral envelope glycoproteins (HIV Env gp160, HCV E1E2) from a chronic HIV/HCV co-infected donor ~3.59 years post HIV infection (ypi) were investigated and multiple unique HIV/HCV cross-reactive B cells were identified. Their specificity was mapped as to a non-neutralizing on HIV gp41 and a neutralizing epitope on HCV E2 corresponding to antigenic region 5 (AR5) by PDB structural alignment, competition ELISA, overlapping peptide ELISA, and in vitro neutralization assay. Importantly, isolated cross-reactive antibodies show extraordinary HCV neutralization breadth, neutralizing 19/19 viruses tested (surpassing the broadest antibody previously tested in this panel, HEPC74, which neutralized 17/19 viruses). Deep sequencing from the same donor (0.79ypi) revealed multiple relatives of the cross-reactive antibodies, and their characterization by recombinant expression revealed that these HIV/HCV cross-reactive antibodies develop from a low-polyreactive, HCV-specific lineage that is hijacked after HIV infection, and subsequent somatic hypermutation leads to increased affinity for HIV. This study is the first to directly demonstrates that antibody lineages raised against one pathogen can enter the immune response against a different, genetically unrelated pathogen. Finally, the extraordinary anti-HCV capacity of identified antibodies indicate their use as therapeutics.

Example 7. Antibodies Recognizing HIV and HCV

Given the identification of potent virus-neutralizing antibodies against both HIV and HCV, antibodies present an attractive target for development of new therapeutic and prophylactic tools in the context of HIV/HCV co-infection. Very little is known, however, about antibodies in HIV/HCV co-infection. To address this question, disclosed herein is characterization of the antibody repertoires of two HIV/HCV co-infected individuals, for which there are samples from multiple timepoints (Table 1). This enables the identification of HIV-specific, HCV-specific, and HIV/HCV cross-reactive antibodies, and to follow their lineage development over time. These studies generate data related to antibody responses in HIV/HCV co-infection and use for therapeutic and vaccine utilization.

TABLE 1

| HIV/HCV co-infected donors in this study. | | | |
| --- | --- | --- | --- |
| Donor ID | Sex | # timepoints | ypi (HIV) |
| 10014 | M | 5 | ~0.5-3 |
| 10032 | F | 5 | 2-5 | ypi, years post-HIV infection.

The identified HIV/HCV cross-reactive antibodies are the first set of antibodies that can specifically cross-react with unrelated viral antigens. This is in contrast with two other settings: (a) antibodies that cross-react with antigens from related viruses (e.g., a cross-reactive antibody against RSV and hMPV), and (b) polyspecific antibodies that non-specifically react with many different antigens.

Antigen-specific B-cell sorting, next-generation sequencing of antibody repertoires, and monoclonal antibody functional validation assays are used to characterize these antibodies. For both donors, 5 timepoints are analyzed, ranging from ~0.5-3 and 2-5 years post-HIV infection, respectively. In both cases, both HIV and HCV infections are present at all five timepoints, which enables one to study the evolution of the antibody response during chronic co-infection. This work identifies and characterizes HIV-specific, HCV-specific, and HIV/HCV cross-reactive antibodies, and defines the evolution of the related antibody lineages over time.

The investigation comprises two steps. Step 1: Perform antigen-specific B-cell sorting for the first and last timepoints for each individual, which leads to the identification of antibodies that are reactive with each antigen. This step results in paired heavy/light chain sequences for antigen-specific antibodies against HIV and/or HCV. Step 2: Perform "deep" sequencing of the antibody repertoires for each timepoint, which allows the tracing of the lineage evolution for the antibodies identified in the antigen-specific sort (step 1). This step results in non-paired heavy and light chain sequences, but at a substantially greater sequencing depth than what is obtained in step 1. Matching non-paired (step 2) with paired (step 1) antibody sequences is done to obtain a detailed analysis of antibody lineage evolution.

Example 8. Identifying Antigen-Specific Antibodies in Co-Infected Individuals For each of the two co-infected donors in this example, samples from the first and last timepoints are analyzed for antigen-specific B cells by using a combination of antigen-specific B-cell sorting and sequencing techniques, resulting in paired heavy/light chain antibody sequence information.

Antigen-specific B-cell sorting. PBMCs from the co-infected donors are stained with a panel of positive and negative cell markers to identify memory B cells and stained with fluorescent antigen to identify virus-specific B cells. Positive B cells are gated as CD3-CD14-IgM-IgG+CD20+CD19+CD27+ and antigen+. The three populations that are analyzed further are: positive for either HIV antigens or for HCV antigens (single-positives), and positive for both (double-positives).

Selection of antigen probes for sorting. The antigens that are used are forms of the Env glycoprotein from HIV-1 and the E1E2 glycoprotein from HCV, which have been identified as targets for neutralizing antibodies. A cocktail of antigen variants are used for each of HIV Env and HCV E1E2. The Env variants include trimeric gp140 stabilized in the closed prefusion conformation, and non-stabilized gp140, gp120, as well as MPER peptide; these constructs are in at least two different strain backgrounds (clade-A BG505 and clade-B B41). The HCV variants include E2 core as well as E1E2 heterodimer, from at least three strains (H77 [genotype 1a], J1 [genotype 2a], and HIC-109 [genotype 3a]). For HIV, all antigen variants are labeled with the same single color; similarly, all HCV antigen variants are labeled with the same single color (that is different from the HIV antigen color). About ten HIV and ten HCV antigens are used for sorting. The goal of including multiple different variants (a cocktail of antigens) for each pathogen is to capture a wider range of antigen-specific antibodies, in order to increase the amount of information obtained for the antigen-specific antibody repertoires. Using multiple antigen variants from multiple strains from each of the two pathogens also increases the chances of identifying antibodies with cross-reactivity between the two pathogens. This is contrasted to other efforts in HIV antibody isolation, which have predominantly focused on identifying broadly neutralizing antibodies (bNAbs), which specifically aim to use stabilized trimers and avoid other antigen forms (such as non-stabilized gp140 or gp120) as antigen-specific probes. Since the assessments herein are not only limited to bNAbs, but rather to capture many different types of antigen-specific antibodies (irrespective of neutralization breadth), a cocktail of antigens is used. Using multiple antigen variants per pathogen also increases the number of antibodies with cross-reactivity.

Antibody sequence determination. 1) For the single-positives, cells are bulk sorted for loading onto the CHRO-MIUM™ microfluidics device (10X Genomics) and processed using the B-cell VDJ solution according to manufacturer's instructions for a target capture of 10,000 B cells per ⅛ 10X cassette. Positive control cell lines (such as the VRC01 Ramon B cell line) can be spiked in to meet the 10X-recommended cell counts and to also provide an idea of efficacy and recovery. Briefly, B-cell populations of interest are sorted into complete RPMI (RPMI 1640+10% FBS) at a concentration of 300 cells/μL. Immediately after sorting, cells are pelleted for 5 minutes at 300×g using an ACCUS- PIN™ Micro17 table-top centrifuge. The pellet is re-suspended in complete RPMI to 800-1200 cells/μL at a viability >90%. For library preparation, cells are partitioned into oil emulsions using a microfluidic circuit, enforcing one cell per reaction mixture. Upon lysis, NGS oligo adaptor sequences present on the oil emulsions capture messenger RNA from each cell. Following PCR amplification, V (D) J genes are further enhanced by targeted enrichment. The resulting cDNA is purified, and BCR and antigen barcode libraries are separated based on amplicon size. Resulting libraries are sequenced using the NOVASEQ 6000™ instrument, each donor sample run through the 10X technology is prepped separately and placed on separate lanes of a flow cell. Output fastq files are processed using Cell Ranger (10X Genomics) to assemble, quantify, and annotate paired V (D) J transcript sequences and antigen barcode counts on a cell-by-cell basis using 10X CHROMIUM™ cellular barcodes. 2) For the double positives, the cells are single-cell sorted in PCR plates containing lysis buffer, and the B-cell receptors (BCR) are amplified out of each cell, and cloned into a mammalian expression vector for recombinant production in 293F cells. BCR sequences are amplified out of single cells using a nested PCR approach, first using primers corresponding to the leader sequence and constant domains, and then with a primer mix for all VH and VL genes and reverse junction primers. In both cases, this process results in paired heavy/light chain sequence information for a set of antigen-specific antibodies (either single- or double-positive).

Step 2 of the non-paired-chain antibody sequencing is the same as that described in Example 3.

A six-months post-infection timepoint from donor 10014 (Table 1) was analyzed. For the antigen-specific B-cell sorting, the following antigens were used: (i) the "BG505 SOSIP" gp140 construct that is stabilized in the closed prefusion conformation of Env; and (ii) The "E2 core" protein, a truncated version of E2 that has been successfully crystallized, and that is known to bind a number of neutralizing antibodies isolated from HCV-infected donors. PBMCs from donor 10014 and separately from a non-infected control were stained with a panel of markers to identify memory B cells, and then stained with fluorescently labeled antigens (as described above) (FIGS. 62A and 62B). While B cells from the non-infected control did not bind the two antigens (FIG. 62A), a number of B cells that were single-positive for either antigen or double-positive for both antigens were identified (FIG. 62B).

Example 9. Monoclonal Antibody Production and Characterization

Monoclonal antibodies are further characterized for their antigen specificity and function. The antibodies are characterized in various assays, including antigen binding, virus neutralization, and epitope mapping.

For each donor, two lineages are selected each from the two single-positive (HIV or HCV) and the double-positive (HIV/HCV) populations, with up to three antibody representatives from each lineage.

Monoclonal antibody production. Selected antibody sequences are cloned into the expression vectors pFUSEss-CHIg-hG1 (heavy), pFUSE2ss-CLIg-hK (kappa light), and pFUSE2ss-CLIg-hL2 (lambda light). 293F cells are co-transfected with plasmids expressing matched pairs of heavy and light chain genes. Recombinant antibodies are purified on a protein A affinity column.

Binding assays. Standard ELISA techniques are used to measure binding of each isolated mAb to a representative panel of envelope proteins from various clades and geno-
types. 2 µg/mL of each envelope glycoprotein construct is
plated overnight on NUNC™ Immuno plates followed by
blocking, and incubation with threefold serial dilutions of
primary antibody starting at 20 µg/mL. Binding is detected
by HRP-conjugated anti-human IgG secondary. Data are
reported as absorbance at 450 nm.

Neutralization assays. To measure neutralization func-
tions of these monoclonal antibodies, the TZM-bl and the
HCVpp assays are used for HIV and HCV respectively,
which are standard in the field. Briefly, viral pseudoparticles
bearing envelope proteins are produced from diverse strains
and these viruses are incubated with serial dilutions of each
antibody. Antibody-pseudovirus mixtures are added to deficiency virus (HIV) envelope protein. B cells were iso-
lated from a co-infected individual using a flow cytometry
assay that measures the binding of B cells to the virus
envelope proteins. B cells that were able to bind both virus
envelope proteins were sorted into 96 well plates, lysed, and
reverse transcribed into cDNA. The B cell receptor
sequences were amplified out of the cDNA and sequenced
using Sanger sequencing through Genhunter (Nashville,
TN). The B cell receptor sequences were then cloned into
mammalian expression vectors for recombinant expression
in mammalian cells. The resulting antibodies were then
purified and tested for binding to the virus envelope proteins
using ELISA. These are the first identified antibodies to
recognize separate, diverse viruses.

TABLE 2

LIBRA-seq Identifies Multiple Unique HIV/HCV Cross-reactive Antibodies.
Sequences in Table: CARSEKRVTMTRKIKGRWFGPW (SEQ ID NO: 1822);
CARVAPPGVVNNKWFDIW (SEQ ID NO: 1821); CAAGLWSGDLSRPRYSDSW (SEQ ID
NO: 1817); CAKGLTTESRLEFW (SEQ ID NO: 1818); CVSSWGPESPYYFDYW (SEQ ID NO:
1819); CAREYCTGGDCHFFLDYW (SEQ ID NO: 1820); CQVWDSSSEHVVF (SEQ ID NO:
1888); CCLYAGSYSWVF (SEQ ID NO: 1887); CMQPLQLPDTF (SEQ ID NO: 1883);
CQQSYNVPTF (SEQ ID NO: 1884); CHQSSSLPFTF (SEQ ID NO: 1885); CQHFYSSPPTF
(SEQ ID NO: 1886).

| mAb name | IGHV gene | IGHJ gene | % SHM | CDR3 | IGLV gene | IGLI gene | % SHM | CDR3 |
|---|---|---|---|---|---|---|---|---|
| mAb180 | IGHV3-48 | IGHJ5 | 0.8877 | CARSEKRVTMTRKIKGRWFGPW | IGLV3-21 | IGLJ2 | 0.9283 | CQVWDSSSEHVVF |
| mAb692 | IGHV1-46 | IGHJ5 | 0.9132 | CARVAPPGVVNNKWFDIW | IGLV2-11 | IGLJ3 | 0.9028 | CCLVAGSYSWVF |
| mAb504 | IGHV3-15 | IGHJ4 | 0.8741 | CAAGLWSGDLSRPRYSDSW | IGKV2-28 | IGKJ4 | 0.9558 | CMWQPLQLPDTF |
| mAb688 | IGHV3-23 | IGHJ5 | 0.875 | CAKGLTTESRLEFW | IGKV1-39 | IGKJ1 | 0.8674 | CQQSYNVPTF |
| mAb803 | IGHV3-21 | IGHJ4 | 0.9514 | CVSSWGPESPVYFDYW | IGKV6-21 | IGKJ3 | 0.9642 | CHQSSSLPFTF |
| mAbKP1-8 | IGHV1-8 | IGHJ4 | 0.9028 | CAREYCTGGDCHFFLDYW | IGKV4-1 | IGKJ3 | 0.9327 | CQHFYSSPPTF |

TZM-bl or Huh-7 cell lines, and infectivity is measured by
a luciferase reporter in relative light units (RLU). Neutral-
ization is evaluated by ID50, here defined as the dilution at
which the antibody is able to inhibit 50% of the cells from
being infected. Established panels of twelve and six diverse
strains are used for the neutralization assays with HIV and
HCV, respectively, to determine overall neutralization
breadth for the tested antibodies.

Epitope mapping. Standard mapping techniques are
applied, such as binding competition with monoclonal anti-
bodies, neutralization or binding of Env variants containing
epitope-specific knockout mutations, and neutralization
blocking by epitope-specific antigens. In addition, the neu-
tralization fingerprint (NFP) epitope mapping approach is
used.

This study results in the identification and characteriza-
tion of antibodies that are specific to HIV or HCV, or
antibodies that are cross-reactive. The analysis of multiple
timepoints for each donor provides insights into the evolu-
tion of the antibody response to each virus. This large-scale
sequencing data allows the generation of detailed lineages of
antigen-specific antibodies. Hence, lineage sequence analy-
sis can determine properties such as CDR3 length and
physicochemical composition, somatic hypermutation dis-
tributions, numbers of antibody lineage members, etc. Such
assessments can compare and identify similarities and dif-
ferences between HIV-specific vs. HCV-specific lineages,
and determine how these change over time.

Disclosed herein are antibodies that can bind both Hepa-
titis C virus (HCV) envelope protein and Human Immuno- Sequences A large number of sequences were analyzed throughout
this application. Additional sequences reviewed and ana-
lyzed include:

SEQ ID NOs: 1905-2627 which are "Barcode" sequences;

SEQ ID NOs: 2628-3258 which are "SEQUENCE_
VDJ.H" sequences;

SEQ ID NOs: 3259-3880 which are "JUNCTION.H"
sequences;

SEQ ID NOs: 7771-8518 which are "SEQUENCE_
VDJ.L" sequences;

SEQ ID NOs: 8520-9189 which are "JUNCTION.L"
sequences.

Unless defined otherwise, all technical and scientific
terms used herein have the same meanings as commonly
understood by one of skill in the art to which the disclosed
invention belongs. Publications cited herein and the mate-
rials for which they are cited are specifically incorporated by
reference.

Those skilled in the art will appreciate that numerous
changes and modifications can be made to the preferred
embodiments of the invention and that such changes and
modifications can be made without departing from the spirit
of the invention. It is, therefore, intended that the appended
claims cover all such equivalent variations as fall within the
true spirit and scope of the invention.

SEQUENCE LISTING (13155 sequences)

SEQ ID NO: 1 - protein, 9 aa, Artificial Sequence
  Synthetic construct
MQALQHPHT

SEQ ID NO: 2 - protein, 9 aa, Artificial Sequence
  Synthetic construct
MQALQIPIT

SEQ ID NO: 3 - protein, 9 aa, Artificial Sequence
  Synthetic construct
MQALQIPPT

SEQ ID NO: 4 - protein, 9 aa, Artificial Sequence
  Synthetic construct
MQALQIPYT

SEQ ID NO: 5 - protein, 9 aa, Artificial Sequence
  Synthetic construct
MQALQSPHT

SEQ ID NO: 6 - protein, 9 aa, Artificial Sequence
  Synthetic construct
MQALQSPPT

SEQ ID NO: 7 - protein, 9 aa, Artificial Sequence
  Synthetic construct
MQALQSPYT

SEQ ID NO: 8 - protein, 9 aa, Artificial Sequence
  Synthetic construct
MQALQVPPT

SEQ ID NO: 9 - protein, 9 aa, Artificial Sequence
  Synthetic construct
MQDLQTPLT

SEQ ID NO: 10 - protein, 9 aa, Artificial Sequence
  Synthetic construct
MQGLQAPLT

SEQ ID NO: 11 - protein, 9 aa, Artificial Sequence
  Synthetic construct
MQGLQIPYT

SEQ ID NO: 12 - protein, 9 aa, Artificial Sequence
  Synthetic construct
MQGLQTPLT

SEQ ID NO: 13 - protein, 9 aa, Artificial Sequence
  Synthetic construct
MQPLQLPDT

SEQ ID NO: 14 - protein, 9 aa, Artificial Sequence
  Synthetic construct
MQPLQPPLT

SEQ ID NO: 15 - protein, 9 aa, Artificial Sequence
  Synthetic construct
MQPLQTPLT

SEQ ID NO: 16 - protein, 9 aa, Artificial Sequence
  Synthetic construct
MQSLQAPLT

SEQ ID NO: 17 - protein, 9 aa, Artificial Sequence
  Synthetic construct
MQTLQLPLT

SEQ ID NO: 18 - protein, 9 aa, Artificial Sequence
  Synthetic construct
MQTLQLPRT

SEQ ID NO: 19 - protein, 9 aa, Artificial Sequence
  Synthetic construct
MQVLQTPLT

SEQ ID NO: 20 - protein, 9 aa, Artificial Sequence
  Synthetic construct
MQYLQTPLT

SEQ ID NO: 21 - protein, 8 aa, Artificial Sequence
  Synthetic construct
QQSYIAPT

SEQ ID NO: 22 - protein, 8 aa, Artificial Sequence
  Synthetic construct
QQSYIGQT

SEQ ID NO: 23 - protein, 8 aa, Artificial Sequence
  Synthetic construct
QQSYNAPT

SEQ ID NO: 24 - protein, 8 aa, Artificial Sequence
  Synthetic construct
QQSYNTPT

SEQ ID NO: 25 - protein, 8 aa, Artificial Sequence
  Synthetic construct
QQSYNVPT

SEQ ID NO: 26 - protein, 8 aa, Artificial Sequence
  Synthetic construct
QQSYPPPT

SEQ ID NO: 27 - protein, 8 aa, Artificial Sequence
  Synthetic construct
QQSYRTPT

SEQ ID NO: 28 - protein, 8 aa, Artificial Sequence
  Synthetic construct
QQSYRTVT

SEQ ID NO: 29 - protein, 8 aa, Artificial Sequence
  Synthetic construct
QQSYTTPT

SEQ ID NO: 30 - protein, 8 aa, Artificial Sequence
  Synthetic construct
QQSYTTRT

SEQ ID NO: 31 - protein, 8 aa, Artificial Sequence
  Synthetic construct
QQSYTTWT

SEQ ID NO: 32 - protein, 8 aa, Artificial Sequence
  Synthetic construct
QQSYYTPT

SEQ ID NO: 33 - protein, 9 aa, Artificial Sequence
  Synthetic construct
HQSRSLPFT

SEQ ID NO: 34 - protein, 9 aa, Artificial Sequence
  Synthetic construct
HQSSSFLFT

SEQ ID NO: 35 - protein, 9 aa, Artificial Sequence
  Synthetic construct
HQSSSFSFT

SEQ ID NO: 36 - protein, 9 aa, Artificial Sequence
  Synthetic construct
HQSSSLGGT

SEQ ID NO: 37 - protein, 9 aa, Artificial Sequence
  Synthetic construct
HQSSSLLFT

SEQ ID NO: 38 - protein, 9 aa, Artificial Sequence
  Synthetic construct
HQSSSLPFA

SEQ ID NO: 39 - protein, 9 aa, Artificial Sequence
  Synthetic construct
HQSSSLPFT

SEQ ID NO: 40 - protein, 9 aa, Artificial Sequence
  Synthetic construct
HQSSSLPHT

SEQ ID NO: 41 - protein, 9 aa, Artificial Sequence
  Synthetic construct
HQSSSLPQT

SEQ ID NO: 42 - protein, 9 aa, Artificial Sequence
  Synthetic construct
HQSSSLPWT

SEQ ID NO: 43 - protein, 9 aa, Artificial Sequence
  Synthetic construct
HQSSSLPYT

SEQ ID NO: 44 - protein, 9 aa, Artificial Sequence
  Synthetic construct
HQSSSLQFT

SEQ ID NO: 45 - protein, 9 aa, Artificial Sequence
  Synthetic construct
HQTSSLPFT

SEQ ID NO: 46 - protein, 9 aa, Artificial Sequence
  Synthetic construct
QHFYSDPPT

SEQ ID NO: 47 - protein, 9 aa, Artificial Sequence
  Synthetic construct
QHFYSKPPT

SEQ ID NO: 48 - protein, 9 aa, Artificial Sequence
  Synthetic construct
QHFYSNPPT

SEQ ID NO: 49 - protein, 9 aa, Artificial Sequence
  Synthetic construct
QHFYSSPPT

SEQ ID NO: 50 - protein, 9 aa, Artificial Sequence
  Synthetic construct
QHFYTNPPT

SEQ ID NO: 51 - protein, 9 aa, Artificial Sequence
  Synthetic construct
QHLYSNPPT

SEQ ID NO: 52 - protein, 9 aa, Artificial Sequence
  Synthetic construct
KQPLQHPYT

SEQ ID NO: 53 - protein, 9 aa, Artificial Sequence
  Synthetic construct
MPPLQTPYT

SEQ ID NO: 54 - protein, 9 aa, Artificial Sequence
  Synthetic construct
MQFLQHPYT

SEQ ID NO: 55 - protein, 9 aa, Artificial Sequence
  Synthetic construct
MQPLQIPGT

SEQ ID NO: 56 - protein, 9 aa, Artificial Sequence
  Synthetic construct
MQPLQIPTT

SEQ ID NO: 57 - protein, 9 aa, Artificial Sequence
  Synthetic construct
MQPLQPPLT

SEQ ID NO: 58 - protein, 9 aa, Artificial Sequence
  Synthetic construct
MQPLQRPCT

SEQ ID NO: 59 - protein, 9 aa, Artificial Sequence
  Synthetic construct
MQPLQTPGT

SEQ ID NO: 60 - protein, 9 aa, Artificial Sequence
  Synthetic construct
MQPLQTPHT

SEQ ID NO: 61 - protein, 9 aa, Artificial Sequence
  Synthetic construct
MQPLQTPKT

SEQ ID NO: 62 - protein, 9 aa, Artificial Sequence
  Synthetic construct
MQPLQTPRT

SEQ ID NO: 63 - protein, 9 aa, Artificial Sequence
  Synthetic construct
MQPLQTPYT

SEQ ID NO: 64 - protein, 9 aa, Artificial Sequence
  Synthetic construct
MQPLQVPQT

SEQ ID NO: 65 - protein, 8 aa, Artificial Sequence
  Synthetic construct
QQSYGTAT

SEQ ID NO: 66 - protein, 8 aa, Artificial Sequence
  Synthetic construct
QQSYIAPT

SEQ ID NO: 67 - protein, 8 aa, Artificial Sequence
  Synthetic construct
QQSYITRT

SEQ ID NO: 68 - protein, 8 aa, Artificial Sequence
  Synthetic construct
QQSYNAGT

SEQ ID NO: 69 - protein, 8 aa, Artificial Sequence
  Synthetic construct
QQSYNTLT

SEQ ID NO: 70 - protein, 8 aa, Artificial Sequence
  Synthetic construct
QQSYRTLT

SEQ ID NO: 71 - protein, 8 aa, Artificial Sequence
  Synthetic construct
QQSYSTLT

SEQ ID NO: 72 - protein, 8 aa, Artificial Sequence
  Synthetic construct
QQSYTTLT

SEQ ID NO: 73 - protein, 8 aa, Artificial Sequence
  Synthetic construct
QQSYTTRT

SEQ ID NO: 74 - protein, 9 aa, Artificial Sequence
  Synthetic construct
HQSASLPQA

SEQ ID NO: 75 - protein, 9 aa, Artificial Sequence
  Synthetic construct
HQSGSLPFT

SEQ ID NO: 76 - protein, 9 aa, Artificial Sequence
  Synthetic construct
HQSKSLPLA

SEQ ID NO: 77 - protein, 9 aa, Artificial Sequence
  Synthetic construct
HQSRSLPFT

SEQ ID NO: 78 - protein, 9 aa, Artificial Sequence
  Synthetic construct
HQSSSLPFA

SEQ ID NO: 79 - protein, 9 aa, Artificial Sequence
  Synthetic construct
HQSSSLPQA

SEQ ID NO: 80 - protein, 9 aa, Artificial Sequence
  Synthetic construct
HQSSSLPYP

SEQ ID NO: 81 - protein, 9 aa, Artificial Sequence
  Synthetic construct
HQSSSLPYS

SEQ ID NO: 82 - protein, 9 aa, Artificial Sequence
  Synthetic construct
HQSTSLPYS

SEQ ID NO: 83 - protein, 9 aa, Artificial Sequence
  Synthetic construct
HQSYSLPFA

SEQ ID NO: 84 - protein, 9 aa, Artificial Sequence
  Synthetic construct
QHFYSDPPT

SEQ ID NO: 85 - protein, 9 aa, Artificial Sequence
  Synthetic construct
QHFYSKPPT

SEQ ID NO: 86 - protein, 9 aa, Artificial Sequence
  Synthetic construct
QHFYSNPPT

SEQ ID NO: 87 - protein, 9 aa, Artificial Sequence
  Synthetic construct
QHFYTNPPT

SEQ ID NO: 88 - protein, 10 aa, Artificial Sequence
  Synthetic construct
CLYAGSYSWV

SEQ ID NO: 89 - protein, 10 aa, Artificial Sequence
  Synthetic construct
CPYAGSYTWV

SEQ ID NO: 90 - protein, 10 aa, Artificial Sequence
  Synthetic construct
CSYAGRYNWV

SEQ ID NO: 91 - protein, 10 aa, Artificial Sequence
  Synthetic construct
CSYAGSYNWV

SEQ ID NO: 92 - protein, 10 aa, Artificial Sequence
  Synthetic construct
CSYAGSYWAV

SEQ ID NO: 93 - protein, 10 aa, Artificial Sequence
  Synthetic construct
CTYAGSYTWV

SEQ ID NO: 94 - protein, 11 aa, Artificial Sequence
  Synthetic construct
QACDSSSDHVV

SEQ ID NO: 95 - protein, 11 aa, Artificial Sequence
  Synthetic construct
QAWDSSNDHVV

SEQ ID NO: 96 - protein, 11 aa, Artificial Sequence
  Synthetic construct
QAWDSSSDHVV

SEQ ID NO: 97 - protein, 11 aa, Artificial Sequence
  Synthetic construct
QAWYSSSDHVV

SEQ ID NO: 98 - protein, 11 aa, Artificial Sequence
  Synthetic construct
QLWDSSSEHVV

SEQ ID NO: 99 - protein, 11 aa, Artificial Sequence
  Synthetic construct
QMWDSSSDHVV

SEQ ID NO: 100 - protein, 11 aa, Artificial Sequence
  Synthetic construct
QMWDSSSEHVV

SEQ ID NO: 101 - protein, 11 aa, Artificial Sequence
  Synthetic construct
QVWDSSSEHVV

SEQ ID NO: 102 - protein, 16 aa, Artificial Sequence
  Synthetic construct
ARGPPPGVANHKWFDT

SEQ ID NO: 103 - protein, 16 aa, Artificial Sequence
  Synthetic construct
ARITPPGVVNNKWFDL

SEQ ID NO: 104 - protein, 16 aa, Artificial Sequence
  Synthetic construct
ARVAPPGVVNNKWFDI

SEQ ID NO: 105 - protein, 16 aa, Artificial Sequence
  Synthetic construct
ARVAPPGVVNNKWFDT

SEQ ID NO: 106 - protein, 16 aa, Artificial Sequence
  Synthetic construct
ARVPPPGVANHKWFDT

SEQ ID NO: 107 - protein, 16 aa, Artificial Sequence
  Synthetic construct
ARVPPPGVVNNKWLDL

SEQ ID NO: 108 - protein, 16 aa, Artificial Sequence
  Synthetic construct
ARVSPPGVVNKKWFDI

SEQ ID NO: 109 - protein, 20 aa, Artificial Sequence
  Synthetic construct
ARSEKRITMARKIKGRWFDP

SEQ ID NO: 110 - protein, 20 aa, Artificial Sequence
  Synthetic construct
ARSEKRVTMTRKIKGRWFGP

SEQ ID NO: 111 - protein, 20 aa, Artificial Sequence
  Synthetic construct
SRSEPRKTTARKIKGRWFDP

SEQ ID NO: 112 - protein, 20 aa, Artificial Sequence
  Synthetic construct
TRSEKRITLALKIKGRWFDP

SEQ ID NO: 113 - protein, 20 aa, Artificial Sequence
  Synthetic construct
TRSEKRITLARKIKGRWFDP

SEQ ID NO: 114 - protein, 20 aa, Artificial Sequence
  Synthetic construct
TRSEKRITLVRKIKGRWFDP

SEQ ID NO: 115 - protein, 20 aa, Artificial Sequence
  Synthetic construct
TRSEKRNTMARKIKGRSFDS

SEQ ID NO: 116 - protein, 20 aa, Artificial Sequence
  Synthetic construct
TRSEKRNTMARKIKGRWFDS

SEQ ID NO: 117 - protein, 20 aa, Artificial Sequence
  Synthetic construct
TRSENRLTLARKIKGRWFGP

SEQ ID NO: 118 - protein, 20 aa, Artificial Sequence
  Synthetic construct
TRSEPRNTLARKIKGRWFDP

SEQ ID NO: 119 - protein, 112 aa, Artificial Sequence
  Synthetic construct
DIVLTQSPLSLSVTPGEPASISCRSNQSLLHNNGYNFLDWYLQKPGQSPQLLIYLASSRASGVPDRFSGSGSGTDFTLRISRVEAEDVGVYYCMQPLQLPDTFGGGTKVEIK

SEQ ID NO: 120 - protein, 111 aa, Artificial Sequence
  Synthetic construct
DIVMTQSPLSLPVTPGEPASISCRSSQSLLHGNGYNFLDWYLQRPGQSPHLLIYLGSNRASGVPDRFSGSGSGTSFTLTISRVEAEDVGVYYCMQSLQAPLTFGGGTNVEI

SEQ ID NO: 121 - protein, 112 aa, Artificial Sequence
  Synthetic construct
DIVLTQSPLSLAVTPGEPASISCRSSQSLLHNNGYNFLDWYVQKPGQSPQLLIYLGSYRASGVPDRFSGSGSGTDFTLKISRVEAEDVGVYYCMQPLQLPDTFGGGTRVEIK

SEQ ID NO: 122 - protein, 112 aa, Artificial Sequence
  Synthetic construct
DIVLTQSPLSLPVTPGESASISCRSSQSLLHSNGYNFLDWYVQKPGQSPQLLIYLGSYRASGVPDRFSGSGSGTDFTLKISRVEAEDVGVYYCMQPLQLPDTFGGGTKVEIK

SEQ ID NO: 123 - protein, 112 aa, Artificial Sequence; identical to SEQ ID NO: 122
  Synthetic construct

SEQ ID NO: 124 - protein, 112 aa, Artificial Sequence
  Synthetic construct
DIVMTQSPLSLSVTPGEPASISCRSSQSLLHSNGYNFLDWYVQKPGQSPQLLIYLASSRASGVPDRFSGSGSGTDFTLKISRVEAEDVGVYYCMQPLQLPDTFGGGTKVEIK

SEQ ID NO: 125 - protein, 112 aa, Artificial Sequence
  Synthetic construct
DIVMTQSPLSLPVTPGELASISCRSSQSLLHSNGYNYLDWYLQKPGQSPQLLIYLGSNRASGVPDRFSGSGSGTDFTLKISRVEADDAGVYYCMQTLQLPRTFGGGTTVEIK

SEQ ID NO: 126 - protein, 112 aa, Artificial Sequence
  Synthetic construct
DIVMTQSPLSLPVTPGESASISCRSSQSLLHSNGYNYLDWYLQKPGQSPQLLIYLGSNRASGVPDRFSGSGADTDFTLKISRVEAEDVGVYYCMQALQSPYTFGGGTKLEIK

SEQ ID NO: 127 - protein, 112 aa, Artificial Sequence
  Synthetic construct
DIVMTQSPLSLPVTPGEPASISCKSSQSLLHSNGHNYLDWYLQKPGQSPQLLIYLGSNRASGVPDRFSGSGSGTDFTLKISRVEPEDVGVFYCMQGLQTPLTFGGGTKVEIK

SEQ ID NO: 128 - protein, 112 aa, Artificial Sequence
  Synthetic construct
DIVMTQSPLSLPVTPGEPASISCRSSQSLLHSNGYNYLDWYLQKPGQCPQLLIYLGSNRASGVPDRISGIGSGTDFTLKISRVEAEDVGVYYCMQGLQTPLTFGGGTKVEIK

SEQ ID NO: 129 - protein, 86 aa, Artificial Sequence
  Synthetic construct
QSLLHSNGYNYLDWYLQKPGQSPQLLIYLASNRASGVPGRFSGSGSGKDFTLKISRVEAEDIGVYYCMQGLQTPLTFGGGTKVEIK

SEQ ID NO: 130 - protein, 112 aa, Artificial Sequence
  Synthetic construct
DIVMTQSPLSLPVTPGEPASISCRSSQSLLHSNGYNYLAWYLQKPGQSPQLLIYLGSNRASGVPDRFSGSGSGTDFTLRISRVEAEDVGIYYCMQGLQTPLTFGGGTKVEIK

SEQ ID NO: 131 - protein, 111 aa, Artificial Sequence
  Synthetic construct
DIVMTQSPLSLPVTPGEPASISCRSSKSLQHRNGNNYLDWYVQKPGQSPQVLIYLGSNRASGVPDRFSGSGSGTDFTLKISRVEAEDVGVYYCMQGLQTPLTFGGGTKVEI

SEQ ID NO: 132 - protein, 112 aa, Artificial Sequence
  Synthetic construct
DIVLTQSPLSLSVTPGEPASISCKSSQSLLDSHGYNSLDWYLQKSGESPQLLIYVASHRASGVPDRFSGSESGTDFTLKISRVEAEDVGVYYCMQGLQTPLTFGGGTKLEIK

SEQ ID NO: 133 - protein, 112 aa, Artificial Sequence
  Synthetic construct
DIVMTQSPLSLPVTPGEPASISCRSSQSLLHTNGYNYLDWYLQKPGQSPQLLIYLGSNRASGVPDRFSGSGSGIDFTLKISRVEAEDVGVYYCMQGLQTPLTFGGGTKVEIK

SEQ ID NO: 134 - protein, 86 aa, Artificial Sequence
  Synthetic construct
QSLLHSNGYNYLDWYLQKPGQSPQLLIYLGSNRASGVPDRFSGSGSGTDFTLKISRVEAEDVGVYYCMQGLQTPLTFGGGTKVEIK

SEQ ID NO: 135 - protein, 112 aa, Artificial Sequence
  Synthetic construct
DIVMTQSPLSLPVTPGEPASISCRSSQSLLHSNGYNYLDWYLQKPGQSPQLLIYMGSNRASGVPDRFSGSGSGTDFTLKISRVEAEDVGIYYCMQGLQTPLTFGGGTKVEIK

SEQ ID NO: 136 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPLTFGGGTKVEIK

SEQ ID NO: 137 - protein, 112 aa, Artificial Sequence; identical to SEQ ID NO: 135
  Synthetic construct

SEQ ID NO: 138 - protein, 112 aa, Artificial Sequence; identical to SEQ ID NO: 130
  Synthetic construct

SEQ ID NO: 139 - protein, 112 aa, Artificial Sequence
  Synthetic construct
DIVMTQSPLSLPVTPGEPASISCKSSQSLLYSNGHNYLDWYLQKPGQSPQLLIYLGSNRASGVPDRFSGSGSGTDFTLKISRVEPEDVGVFYCMQGLQTPLTFGGETKVEIK

SEQ ID NO: 140 - protein, 112 aa, Artificial Sequence; identical to SEQ ID NO: 130
  Synthetic construct

SEQ ID NO: 141 - protein, 112 aa, Artificial Sequence
  Synthetic construct
DIVMTQSPLSLPVTPGEAASISCRSSQSLLHSNGYKYLDWYLQKPGQSPQLLIYLGSNRASGVPDRFSGSGSGTDFTLKISRVEAEDVGVYFCMQGLQTPLTFGGGTKVEIK

SEQ ID NO: 142 - protein, 112 aa, Artificial Sequence
  Synthetic construct
DIVMTQSPLSLPVTPGQPASISCRSSQSLLHSNGYNYLDWYLQKPGQSPQLLIYVGSNRASGVPDRFSGSGSGTDFTLKISRVEAEDVGVYYCMQGLQTPLTFGGGTKVEIK

SEQ ID NO: 143 - protein, 57 aa, Artificial Sequence
  Synthetic construct
GSHRASGVPDRFIGSGSGTDFTLKISRVEAEDVGVYYCMQALQIPYTFGGGTRVEIK

SEQ ID NO: 144 - protein, 86 aa, Artificial Sequence
  Synthetic construct
QSLLYSTGYNHLDWYLQKPGQSPQLLISLGSNRASGVPDRFSGSGSGTDFALKISRVEAEDVGVYYCMQALQIPYTFGGGTRVEIK

SEQ ID NO: 145 - protein, 57 aa, Artificial Sequence; identical to SEQ ID NO: 143
  Synthetic construct

SEQ ID NO: 146 - protein, 112 aa, Artificial Sequence
  Synthetic construct
DIVMTQPPLPLPVIPGEPASFSCTSSQSLLHGNGYNYLDRYLQKPGQSPQLLIYLGSNRASGVPDRFSGSGSGTDFTLRISRVEADDVGVYYCMQALQIPYTFGVGTKMEIK

SEQ ID NO: 147 - protein, 112 aa, Artificial Sequence
  Synthetic construct
DIVMTQSPLSLPVTPGEPASISCRSSQSLLHANGYNYLDWYLQRPGQSPQLLIYLGSNRASGVPDRFSGSGSGTDFTLKISRVEAEDVGVYYCMQALQVPPTFGGGTTVEIK

SEQ ID NO: 148 - protein, 112 aa, Artificial Sequence
  Synthetic construct
DIVMTQSPLSLPVTPGEPASISCKSSRSLLHSNGKTYLDWFLQKPGQSPQLLISLGSNRASGVPDRFSGSGSGTDFTLKISRMEAEDVGVYYCMQGLQAPLTFGGGTKVEIK

SEQ ID NO: 149 - protein, 112 aa, Artificial Sequence
  Synthetic construct
DIVVTQSPLSLSVTPGEPASISCRSSQTLLYSNGYNYLDWYLQKPGQSPQLLIYLGSNRASGVSDRFSASGSGTDFTLKISKVEADDAGVYYCMQTLQLPLTFGGGTTVETK

SEQ ID NO: 150 - protein, 112 aa, Artificial Sequence
  Synthetic construct
DIVVTQSPLSLSVTPGEPAPISCRSSQTLLYSNGYNYLDWYLQKPGQSPQLLIYLGSNRASGVSDRFSASGSGTDFTLKISKVEADDAGVYYCMQTLQLPLTFGGGTTVEIK

SEQ ID NO: 151 - protein, 112 aa, Artificial Sequence
  Synthetic construct
DIVVTQSPLSLSVTPGEPASISCRSSQTLLYSNGYNYLDWYLQKPGQSPQLLIYLGSNRASGVSDRFSASGSGTDFTLKISKVEADDAGVYYCMQTLQLPLTFGGGTTVEIK

SEQ ID NO: 152 - protein, 112 aa, Artificial Sequence; identical to SEQ ID NO: 151
  Synthetic construct

SEQ ID NO: 153 - protein, 112 aa, Artificial Sequence
  Synthetic construct
DIVVTQSPLSLSVTPGEPASISCRSSQTLLYSNGYNYLDWYLQKPGQSPQLLIYLGSNRASGVSDRFSASGSGTDFTLKISKVEADDAGVYFCMQTLQLPLTFGGGTTVEIK

SEQ ID NO: 154 - protein, 112 aa, Artificial Sequence
  Synthetic construct
DIVVTQSPLSLSVTPGEPASISCRSSQTLLYSNGYNYLDWYLQKPGQSPQLLIYLGSNRASGVSDRFSASGSGTDLTLKISKVEADDAGVYYCMQTLQLPLTFGGGTTVEIK

SEQ ID NO: 155 - protein, 112 aa, Artificial Sequence; identical to SEQ ID NO: 151
  Synthetic construct

SEQ ID NO: 156 - protein, 112 aa, Artificial Sequence; identical to SEQ ID NO: 151
  Synthetic construct

SEQ ID NO: 157 - protein, 112 aa, Artificial Sequence; identical to SEQ ID NO: 151
  Synthetic construct

SEQ ID NO: 158 - protein, 86 aa, Artificial Sequence
  Synthetic construct
QTLLYSNGYNYLDWYLQKPGQSPQLLIYLGSNRASGVSDRFSASGSGTDFTLKISKVEADDAGVYYCMQTLQLPLTFGGGTTVEIK

SEQ ID NO: 159 - protein, 86 aa, Artificial Sequence; identical to SEQ ID NO: 158
  Synthetic construct

SEQ ID NO: 160 - protein, 112 aa, Artificial Sequence; identical to SEQ ID NO: 151
  Synthetic construct

SEQ ID NO: 161 - protein, 112 aa, Artificial Sequence; identical to SEQ ID NO: 151
  Synthetic construct

SEQ ID NO: 162 - protein, 112 aa, Artificial Sequence
  Synthetic construct
DIVVTQSPLSLSVTPGELASISCRSSQTLLYSNGYNYLDWYLQKPGQSPQLLIYLGSNRASGVSDRFSASGSGTDFTLKISKVEADDAGVYYCMQTLQLPLTFGGGTTVEIK

SEQ ID NO: 163 - protein, 112 aa, Artificial Sequence; identical to SEQ ID NO: 151
  Synthetic construct

SEQ ID NO: 164 - protein, 86 aa, Artificial Sequence; identical to SEQ ID NO: 158
  Synthetic construct

SEQ ID NO: 165 - protein, 112 aa, Artificial Sequence; identical to SEQ ID NO: 151
  Synthetic construct

SEQ ID NO: 166 - protein, 112 aa, Artificial Sequence
  Synthetic construct
DVVMTQTPLSLPVTPGEPASISCRSSQTLLYSNGYNYLDWYLQKPGQSPQLLIYLGSNRASGGSDRFSASGSGTDFTLKISKVEADDAGVYYCMQTLQLPLTFGGGTTVEIK

SEQ ID NO: 167 - protein, 86 aa, Artificial Sequence; identical to SEQ ID NO: 158
  Synthetic construct

SEQ ID NO: 168 - protein, 112 aa, Artificial Sequence; identical to SEQ ID NO: 151
  Synthetic construct

SEQ ID NO: 169 - protein, 58 aa, Artificial Sequence
  Synthetic construct
LGSNRASGVSDRFSASGSGTDFTLKISKVEADDAGVYYCMQTLQLPLTFGGGTTVEIK

SEQ ID NO: 170 - protein, 112 aa, Artificial Sequence; identical to SEQ ID NO: 151
  Synthetic construct

SEQ ID NO: 171 - protein, 20 aa, Artificial Sequence
  Synthetic construct
CMQTLQLPLTFGGGTTVEIK

SEQ ID NO: 172 - protein, 112 aa, Artificial Sequence; identical to SEQ ID NO: 151
  Synthetic construct

SEQ ID NO: 173 - protein, 112 aa, Artificial Sequence; identical to SEQ ID NO: 151
  Synthetic construct

SEQ ID NO: 174 - protein, 112 aa, Artificial Sequence; identical to SEQ ID NO: 151
  Synthetic construct

SEQ ID NO: 175 - protein, 86 aa, Artificial Sequence; identical to SEQ ID NO: 158
  Synthetic construct

SEQ ID NO: 176 - protein, 112 aa, Artificial Sequence; identical to SEQ ID NO: 151
  Synthetic construct

SEQ ID NO: 177 - protein, 112 aa, Artificial Sequence
  Synthetic construct
DIVVTQSPLSLSVTPGEPASISCRSSQTLLYSNGYNYLDWYLQKPGQSPQLLIYLGSNRASGVSDRFSVSGSGTDFTLKISKVEADDAGVYYCMQTLQLPLTFGGGTTVEIK

SEQ ID NO: 178 - protein, 112 aa, Artificial Sequence; identical to SEQ ID NO: 151
  Synthetic construct

SEQ ID NO: 179 - protein, 112 aa, Artificial Sequence; identical to SEQ ID NO: 151
  Synthetic construct

SEQ ID NO: 180 - protein, 112 aa, Artificial Sequence; identical to SEQ ID NO: 151
  Synthetic construct

SEQ ID NO: 181 - protein, 112 aa, Artificial Sequence; identical to SEQ ID NO: 151
  Synthetic construct

SEQ ID NO: 182 - protein, 112 aa, Artificial Sequence
  Synthetic construct
DIVVTQSPLSLSVTPGEPASISCRSSQALLYSNGYNYLDWYLQKPGQSPQLLIYLGSNRASGVSDRFSASGSGTDFTLKISKVEADDAGVYYCMQTLQLPLTFGGGTTVEIK

SEQ ID NO: 183 - protein, 55 aa, Artificial Sequence
  Synthetic construct
NRASGVSDRFSASGSGTDFTLKISKVEADDAGVYYCMQTLQLPLTFGGGTTVEIK

SEQ ID NO: 184 - protein, 112 aa, Artificial Sequence; identical to SEQ ID NO: 151
  Synthetic construct

SEQ ID NO: 185 - protein, 112 aa, Artificial Sequence; identical to SEQ ID NO: 151
  Synthetic construct

SEQ ID NO: 186 - protein, 112 aa, Artificial Sequence
  Synthetic construct
DIVMTQSPLSLPVTPGEPASISCRSSQSLLHSSGYIGVDWYLQKPGQSPQILIYMGSNRASGVPDRFSGSGSGTDFTLKISRVEAEDVGVYYCMQGLQIPYTFGGGTRVEIK

SEQ ID NO: 187 - protein, 111 aa, Artificial Sequence
  Synthetic construct
DIVMTQSPLSLPVTPGEPASISCRSSQSLLHSAGYNGVDWYLQKPGQSPHLLIYMGSNRASGVPDRFSGSGSGTDFTLKISRVEAEDVGVYYCMQGLQIPYTFGGGTRVEI

SEQ ID NO: 188 - protein, 112 aa, Artificial Sequence
  Synthetic construct
DIVVTQSPLFLVVTPGEPASISCRSSQSLVQSNGYSFLDWYLQKPGQSPQLLIYLGSNRASGVPDRFSGSGSGTDFTLKISKVEAEDVGIYYCMQDLQTPLTFGGGTKVEIK

SEQ ID NO: 189 - protein, 112 aa, Artificial Sequence; identical to SEQ ID NO: 188
  Synthetic construct

SEQ ID NO: 190 - protein, 112 aa, Artificial Sequence
  Synthetic construct
DIVMTQSPLSLPVTPGEPASISCRSSQSLLHSNRYNYLDWYLQKPGQSPQVLIYLGSNRASGVPDRFSGSGSGTDFTLKISRVEAEDVGVYYCMQYLQTPLTFGGGTKVEIK

SEQ ID NO: 191 - protein, 112 aa, Artificial Sequence; identical to SEQ ID NO: 190
  Synthetic construct

SEQ ID NO: 192 - protein, 20 aa, Artificial Sequence
  Synthetic construct
CMQALQHPHTFGGGTKMEIK

SEQ ID NO: 193 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVAAEDVGVYYCMQALQSPPTFGGGTTVEIK

SEQ ID NO: 194 - protein, 86 aa, Artificial Sequence
  Synthetic construct
QSLLNDDEYNYLDWYLQKPGQSPQLLIYLGSYRASGVSDRFSGSGSGTEFTLKISRVEPEDVGIYYCMQALQSPPTFGGGTKVEIK

SEQ ID NO: 195 - protein, 112 aa, Artificial Sequence
  Synthetic construct
DIVMTQSPLSLPVTPGEPASISCRSSQSLLHSNGYNYLDRYLQKPGQSPQLLIYLGSNRASGVADRFSGSGSGTDFTLKISRVAAEDVGVYYCMQALQSPPTFGGGTTVEIK

SEQ ID NO: 196 - protein, 112 aa, Artificial Sequence
  Synthetic construct
DIVMTQSPLSLPVTPGEPASISCRSSQSLLHANGYNYLDWYLQRPGQSPQLLIYLGSNRASGVPDRFSGSGSGTDFTLKISRVEAEDVGVYYCMQALQIPPTFGGGTTVEIK

SEQ ID NO: 197 - protein, 112 aa, Artificial Sequence; identical to SEQ ID NO: 196
  Synthetic construct

SEQ ID NO: 198 - protein, 112 aa, Artificial Sequence
  Synthetic construct
DVVLTQSPVSLPVTPGDPASISCRSSQSLLHANGYNYLDWYLQRPGQSPQLLIYLGSNRASGVPDRFSGSGSGTDFTLKISRVEAEDVGVYYCMQALQIPPTFGGGTTVEIK

SEQ ID NO: 199 - protein, 112 aa, Artificial Sequence
  Synthetic construct
DIVMTQSPLSLPVTPGEPASISCRSSQSLLHANGYNYLDWYLQRPGQSTQLLIYLGSNRASGVPDRFSGSGSGTDFTLKISRVEAEDVGVYYCMQALQIPPTFGGGTTVEIK

SEQ ID NO: 200 - protein, 112 aa, Artificial Sequence
  Synthetic construct
DIVMTQSPLSLPVTPGEPASISCRSSQSLLHTNGYNYLDWYLQKPGQSPQLLIFLGSNRASGVPDRFSGSGSGTDFTLKITRVEAEDVGVYYCMQALQIPPTFGGGTTVEIK

SEQ ID NO: 201 - protein, 20 aa, Artificial Sequence
  Synthetic construct
CMQALQIPPTFGGGTTVEIK

SEQ ID NO: 202 - protein, 112 aa, Artificial Sequence; identical to SEQ ID NO: 196
  Synthetic construct

SEQ ID NO: 203 - protein, 112 aa, Artificial Sequence; identical to SEQ ID NO: 196
  Synthetic construct

SEQ ID NO: 204 - protein, 112 aa, Artificial Sequence; identical to SEQ ID NO: 196
  Synthetic construct

SEQ ID NO: 205 - protein, 20 aa, Artificial Sequence
  Synthetic construct
CMQALQIPPTFGGGTTVEIK

SEQ ID NO: 206 - protein, 112 aa, Artificial Sequence; identical to SEQ ID NO: 196
  Synthetic construct

SEQ ID NO: 207 - protein, 112 aa, Artificial Sequence; identical to SEQ ID NO: 196
  Synthetic construct

SEQ ID NO: 208 - protein, 112 aa, Artificial Sequence; identical to SEQ ID NO: 196
  Synthetic construct

SEQ ID NO: 209 - protein, 112 aa, Artificial Sequence; identical to SEQ ID NO: 196
  Synthetic construct

SEQ ID NO: 210 - protein, 112 aa, Artificial Sequence; identical to SEQ ID NO: 196
  Synthetic construct

SEQ ID NO: 211 - protein, 58 aa, Artificial Sequence
  Synthetic construct
LGSNRASGVPDRFSGSGSGTDFTLKISRVEAEDVGVYYCMQALQIPPTFGGGTTVEIK

SEQ ID NO: 212 - protein, 112 aa, Artificial Sequence; identical to SEQ ID NO: 196
  Synthetic construct

SEQ ID NO: 213 - protein, 112 aa, Artificial Sequence
  Synthetic construct
DIVMTQSPLSLPVAPGEPASISCRSSRSLLHSNGYTYLDWYLQKPGKSPQLLIYLTSDRASGVPDRFSGSGSGSYFTLNISRVEAEDVGVYYCMQALQIPPTFGGGTKVEVK

SEQ ID NO: 214 - protein, 20 aa, Artificial Sequence
  Synthetic construct
CMQALQIPPTFGGGTTVEIK

SEQ ID NO: 215 - protein, 112 aa, Artificial Sequence
  Synthetic construct
DIVMTQSPLSLPVTPGEPASISCRSSQSLLHSNGYNYLDWYLQKLGQSPQLLIYLGSNRASGVPDRFSGSGSGTDFTLKISRVEAEDVGVYYCMQVLQTPLTFGGGTKVEIK

SEQ ID NO: 216 - protein, 112 aa, Artificial Sequence
  Synthetic construct
DIVMTQSPLSLPVTPGEPASISCRSTQSLLHSNGYTYLDWYLQKPGQSPQLLIYLGSNRASGVPDRFSGGGSGTDFTLKISRVEAEDVGVYYCMQVLQTPLTFGGGTKVEIK

SEQ ID NO: 217 - protein, 112 aa, Artificial Sequence
  Synthetic construct
DIVMTQSPLSLPVTPGEPASISCRSTQSLLHSNGYTYLDWYLQKPGQSPQLLIYLGSNRASGVPDRFSGGGSGTDFTLKISRVEAEDVGVYFCMQVLQTPLTFGGGTKVELK

SEQ ID NO: 218 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPLTFGGGTKVEIK

SEQ ID NO: 219 - protein, 75 aa, Artificial Sequence
  Synthetic construct
LNWYLQKPGQSPQLLIYLGSNRASGVPDRLSGSGSGTDFTLKISRVEAEDVGVYYCMQVLQTPLTFGGGTKVEIK

SEQ ID NO: 220 - protein, 86 aa, Artificial Sequence
  Synthetic construct
QSLLDSNGYNYLDWYVQKPGQSPQLLIYLGSNRASGVPDRFGGSGSGTDFTLKISRVEAEDVGVYYCMQVLQTPLTFGGGTKVEIK

SEQ ID NO: 221 - protein, 112 aa, Artificial Sequence
  Synthetic construct
DIVMTQSPLSLPVTPGEPASISCRSSQSLLHSNGYNYLNWYLQKPGQSPQLLIYLGSNRASGVPDRLSGSGSGTDFTLKISRVEAEDVGVYYCMQVLQTPLTFGGGTKVEIK

SEQ ID NO: 222 - protein, 112 aa, Artificial Sequence
  Synthetic construct
DIVMTQSPLSLPVTPGEPASISCRSSQTLLHSNGYNYLDWYLQKPGQSPQLLIYLGSTRAPGVPDRFSGSGSGTDFTLKISRVEAEDVGVYYCMQPLQTPLTFGGGTKVEIK

SEQ ID NO: 223 - protein, 112 aa, Artificial Sequence
  Synthetic construct
DIVVTQSPLFLVVTPGEPASISCRSSQSLVQSNGYSFLDWYLQKPGQSPQLLIYLGSNRASGVPDRFSGSGSGTDFTLKISKVEAEDVGFYYCMQPLQPPLTFGGGTMVEIK

SEQ ID NO: 224 - protein, 112 aa, Artificial Sequence
  Synthetic construct
DIVMTQSPLSLSVTPGEPASISCRSSQSLLHDDEYNYLDWYVQRPGQSPQLLIYLTSYRAAGVPDRFSGSGSGADFTLKISRVEAEDVGTYYCMQALQSPHTFGGGTKVEIK

SEQ ID NO: 225 - protein, 112 aa, Artificial Sequence
  Synthetic construct
DIVLTQSPLSLSVTPGEPASISCRSSQSLLHNNGYNFLDWYVQKPGQSPQLLIYLGSNRASGVPDRFSGSGSGTDFTLKISRVEAEDVGVYYCMQALQSPHTFGGGTRLEIK

SEQ ID NO: 226 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQIPITFGGGTKVEIK

SEQ ID NO: 227 - protein, 105 aa, Artificial Sequence
  Synthetic construct
DIQMTQSPSSLSASVGDRVTITCRASQYIGSFLNWYQQQPGKPPKLLIYAASTLQSGAPLRFSASESGSDFTLTITNLQPEDFATYYCQQSYNVPTFGQGTKVEI

SEQ ID NO: 228 - protein, 106 aa, Artificial Sequence
  Synthetic construct
DIQMTQSPSSLSASVGDRVTLTCRASQSISSNLNWYQQKPGKAPKLLIYLTSNLLGGVPSRFSGSGSGTYFTLNISSLQPEDLATYYCQQSYIGQTFGQGTKVEIK

SEQ ID NO: 229 - protein, 106 aa, Artificial Sequence
  Synthetic construct
DIQMTQSLSSLSASVGDRVTLTCRASQSISSNLNWYQQKPGKAPKLLIYLTSNLLGGVPSRFSGSGSGTYFTLNISSLQPEDLATYYCQQSYIGQTFGQGTKVEIK

SEQ ID NO: 230 - protein, 104 aa, Artificial Sequence
  Synthetic construct
DIQMTQSPSSLSASIGDRVTITCRASQSISDYLNWYQQKPGKAPQLLIYAASNLQGGVPSRFSGSGSGTDFTLTITGLQPEDFATYFCQQSYTTPTFGQGTKVE

SEQ ID NO: 231 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYRTVTFGQGTKVEIK

SEQ ID NO: 232 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYTTWTFGQGTKVEIK

SEQ ID NO: 233 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYPPPTFGQGTKVEIK

SEQ ID NO: 234 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYTTRTFGQGTKVEIK

SEQ ID NO: 235 - protein, 106 aa, Artificial Sequence
  Synthetic construct
DIQMTQSPSSLSASVGDRVTITCRASQSISFYLHWYQQKPGKAPRLLIYDAASLQRGVPSRFSGSGSGTDFSLTISSLQGEDFATYYCQQSYYTPTFGQGTKVEIK

SEQ ID NO: 236 - protein, 106 aa, Artificial Sequence
  Synthetic construct
DIQMTQSPSSLFASVGDRVTITCRASQSITNYLNWYQIKPGIAPKLLITGASGLQSGVPSRFSRSGSGTEFTLTISSLQPEDFANYYCQQSYNAPTFGQRTKVEFK

SEQ ID NO: 237 - protein, 106 aa, Artificial Sequence
  Synthetic construct
DIQMTQSPSSLSASIRDRVAITCRASQSISTYLNWYQQKPGKAPKLLIYAASSLQSGVPSRFSGSGSGTDFTLTISSLQPEDFATYYCQQSYRTPTFGQGTKVEIK

SEQ ID NO: 238 - protein, 106 aa, Artificial Sequence
  Synthetic construct
DIQMTQSPSSLSASVGDRVTITCRASQSISSYLNWYQQKPGKAPKFLIYAASSLQSGVPSRFSGSGSGTDFTLTISSLQPEDFATYYCQQSYIAPTFGQGTKVEIK

SEQ ID NO: 239 - protein, 106 aa, Artificial Sequence
  Synthetic construct
DIQMTQSPSSVSASVGDRVTITCRASQTIGSYLNWFQQKPGKAPKLLIYTASTLESVVPSRFIGSGSGTDFTLTISSLQPDDFATYYCQQSYNTPTFGQGTKVEIK

SEQ ID NO: 240 - protein, 106 aa, Artificial Sequence
  Synthetic construct
DIQMTQSPSSLSASVGDRVTITCRASQSISSYLNWYQQKPGKAPKVLIYAASSLQSGVPSRFSGSGSGTDFTLTISSLQPEDFATYYCQQSYNTPTFGQGTKVESK

SEQ ID NO: 241 - protein, 105 aa, Artificial Sequence
  Synthetic construct
EIQMAQSPSSLSASVGDRVIITCRTSQNISSYLNWYQLKPGKAPKVLIYAASSLQSGVPSRFSGSGSGTDFTLTINSLQPEDLATYYCQQSYNTPTFGQGTKVEI

SEQ ID NO: 242 - protein, 107 aa, Artificial Sequence
  Synthetic construct
EVVLTQSPDFQSVTPKEKVTIICRASQSIGSYLHWYQQKPHQSPKLLIKYASQSISGVPSRFSGSGSGTEFTLTIKSLEAEDAATYYCHQSSSLPFTFGPGTKVDIK

SEQ ID NO: 243 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLGGTFGPGTKVDIK

SEQ ID NO: 244 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPQTFGPGTKVYIK

SEQ ID NO: 245 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPQTFGPGTKVDIK

SEQ ID NO: 246 - protein, 81 aa, Artificial Sequence
  Synthetic construct
QSIGSSLHWYQQKPDQSPKLLIKYASQSISGVPSRFSGSGSGTDFTLTINSLEAEDAATYYCHQSSSLPQTFGPGTKVDIK

SEQ ID NO: 247 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDYTLTINSLEAEDAATYYCHQSSSLPQTFGLGTKVDIK

SEQ ID NO: 248 - protein, 107 aa, Artificial Sequence
  Synthetic construct
EIVLTQSPDFQSVTPKEKVAITCRASQSIGSSLHWYQQKPDQSPKLLIKYASQSISGVPSRFSGSGSGTDFTLTINSLEAEDAATYYCHQSSSLPQTFGPGTKVDIK

SEQ ID NO: 249 - protein, 81 aa, Artificial Sequence; identical to SEQ ID NO: 246
  Synthetic construct

SEQ ID NO: 250 - protein, 107 aa, Artificial Sequence; identical to SEQ ID NO: 245
  Synthetic construct

SEQ ID NO: 251 - protein, 81 aa, Artificial Sequence
  Synthetic construct
QSIGSSLHWYQQKPDQSPKLLIKYASQSISGVPSRFSGSGSGTDFTLTINSLEAEDAATYYCHQSSSLPQTFGPGTKVAIK

SEQ ID NO: 252 - protein, 107 aa, Artificial Sequence
  Synthetic construct
EIVLTQSPAFQSVAPRETVTITCRASQSIGTSLHWYQQKPDQSPKLLINYASQSVSGVPSRFSGSGSGTAFTLTINSLEPEDAATYYCHQSSSLPYTFGPGTKVDIK

SEQ ID NO: 253 - protein, 81 aa, Artificial Sequence
  Synthetic construct
QSIGTSLHWYQQKPDQSPKLLINYASQSVSGVPSRFSGSGSGTAFTLTINSLEPEDAATYYCHQSSSLPYTFGPGTKVEIK

SEQ ID NO: 254 - protein, 107 aa, Artificial Sequence; identical to SEQ ID NO: 252
  Synthetic construct

SEQ ID NO: 255 - protein, 81 aa, Artificial Sequence
  Synthetic construct
QSIGTSLHWYQQKPDQSPKLLINYASQSVSGVPSRFSGSGSGTAFTLTINSLEPEDAATYYCHQSSSLPYTFGPGTKVDIK

SEQ ID NO: 256 - protein, 81 aa, Artificial Sequence; identical to SEQ ID NO: 255
  Synthetic construct

SEQ ID NO: 257 - protein, 81 aa, Artificial Sequence; identical to SEQ ID NO: 255
  Synthetic construct

SEQ ID NO: 258 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDAATYYCHQSRSLPFTFGPGTKVDIK

SEQ ID NO: 259 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSFLFTFGPGTKVDIK

SEQ ID NO: 260 - protein, 107 aa, Artificial Sequence
  Synthetic construct
EIVLTQSPDFQSVTPKEKVTITCRASQSIGSSLHWYQQKPDQPPKLLIKYASQSISGVPSRFSGSGSGTDFTLTINSLEAEDAATYYCHQSSSLLFTFGPGTKVDIK

SEQ ID NO: 261 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDAATYYCHQSSSLLFTFGPGTKVDIK

SEQ ID NO: 262 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDAATYYCHQSSSLQFTFGPGTKVEIK

SEQ ID NO: 263 - protein, 107 aa, Artificial Sequence
  Synthetic construct
EIVLTQSPAFQSVTPKEKVTITCRASQTIGSSLHWYQQKPGQSPKLLIKFASQSFSGVPSRFSGSGSGTNFTLTINSLEAEDAATYYCHQSSSLPFTFGPGTKVDIK

SEQ ID NO: 264 - protein, 107 aa, Artificial Sequence
  Synthetic construct
EIVLTQSPDFQSVTPGEKVTITCRASQSIGTSLHWYQQRPDQSPMLLIKYASQSISGVPSRFSGSGSGTEFTLTINSLEAEDAATYYCHQSSSLPFTFGPGTKLDLK

SEQ ID NO: 265 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDAATYYCHQSSSLPFTFGPGTKVDIK

SEQ ID NO: 266 - protein, 78 aa, Artificial Sequence
  Synthetic construct
QSIGTSLHWYQQRPDQSPMLLIKYASQSISGVPSRFSGSGSGTEFTLTINSLEAEDAATYYCHQSSSLPFTFGPGTKL

SEQ ID NO: 267 - protein, 107 aa, Artificial Sequence; identical to SEQ ID NO: 265
  Synthetic construct

SEQ ID NO: 268 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDAATYYCHQSSSLPFTFGPGTKVDSK

SEQ ID NO: 269 - protein, 107 aa, Artificial Sequence; identical to SEQ ID NO: 265
  Synthetic construct

SEQ ID NO: 270 - protein, 107 aa, Artificial Sequence; identical to SEQ ID NO: 265
  Synthetic construct

SEQ ID NO: 271 - protein, 81 aa, Artificial Sequence
  Synthetic construct
QSIGTSLHWYQQRPDQSPMLLIKYASQSISGVPSRFSGSGSGTEFTLTINSLEAEDAATYYCHQSSSLPFTFGPGTKLDLK

SEQ ID NO: 272 - protein, 107 aa, Artificial Sequence
  Synthetic construct
EIVLTQSPDFQSVTPGEKVTITCRASQSIGTSLHWYQQRPDQSPKLLINYASQSISGVPSRFSGSGSGTDFTLTINSLEAEDAATYYCHQSSSLPFTFGPGTKVDIK

SEQ ID NO: 273 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPFTFGPGTKGDIK

SEQ ID NO: 274 - protein, 107 aa, Artificial Sequence; identical to SEQ ID NO: 272
  Synthetic construct

SEQ ID NO: 275 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPFTFGPGTKVDIK

SEQ ID NO: 276 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAADAATYYCHQSSSLPFTFGPGTKVDIK

SEQ ID NO: 277 - protein, 107 aa, Artificial Sequence; identical to SEQ ID NO: 265
  Synthetic construct

SEQ ID NO: 278 - protein, 107 aa, Artificial Sequence
  Synthetic construct
EIVLTQSPDFQSVTPKEKVTITCRARQSICSSLHWYQQKPDQSPKLLIKYASQSISGVPSRVSGSGSETDFTLTINSLEAEDAATYYCHQSSSLPFTFGPGTKVEIK

SEQ ID NO: 279 - protein, 107 aa, Artificial Sequence; identical to SEQ ID NO: 265
  Synthetic construct

SEQ ID NO: 280 - protein, 107 aa, Artificial Sequence; identical to SEQ ID NO: 275
  Synthetic construct

SEQ ID NO: 281 - protein, 81 aa, Artificial Sequence
  Synthetic construct
QSIGTSLHWYQQRPDQSPMPLIKYASQSISGVPSRFSGSGSGTEFTLTINSLEAEDAATYYCHQSSSLPFTFGPGTKLDLK

SEQ ID NO: 282 - protein, 107 aa, Artificial Sequence; identical to SEQ ID NO: 265
  Synthetic construct

SEQ ID NO: 283 - protein, 107 aa, Artificial Sequence; identical to SEQ ID NO: 272
  Synthetic construct

SEQ ID NO: 284 - protein, 81 aa, Artificial Sequence; identical to SEQ ID NO: 271
  Synthetic construct

SEQ ID NO: 285 - protein, 107 aa, Artificial Sequence
  Synthetic construct
EIVLTQSPDFQSVTPREKVTITCRASQSIGSSLHWYQQKPNQSPKLLIKDASQSFSGVPSRFSGSGSGTDFTLTINSLEAEDAATYYCHQSSSLPFTFGPGTKLEIK

SEQ ID NO: 286 - protein, 81 aa, Artificial Sequence
  Synthetic construct
QSIGSSLHWYQQKPDQSPKLLIKYASQSISGVPSRFSGSGSGTDFTLTINSLEAEDAATYYCHQSSSLPFTFGPGTKVDIK

SEQ ID NO: 287 - protein, 107 aa, Artificial Sequence; identical to SEQ ID NO: 264
  Synthetic construct

SEQ ID NO: 288 - protein, 107 aa, Artificial Sequence
  Synthetic construct
EIVLTQSPDFQSVTPGEKVTITCRASQSIGTSLHWYQQRPNQSPMLLIKYASQSISGVPSRFSGSGSGTEFTLTINSLEAEDAATYYCHQSSSLPFTFGPGTKLDLK

SEQ ID NO: 289 - protein, 107 aa, Artificial Sequence
  Synthetic construct
EIVLTQSPDFQSVTPGEKVTITCRASQSIGTSLHWYQQRPDQSPMLLIKYASQSISGVPSRCSGSGSGTEFTLTINSLEAEDAATYYCHQSSSLPFTFGPGTKLDLK

SEQ ID NO: 290 - protein, 107 aa, Artificial Sequence; identical to SEQ ID NO: 272
  Synthetic construct

SEQ ID NO: 291 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLPINSLEAEDAATYYCHQSSSLPFTFGPGTKVEIK

SEQ ID NO: 292 - protein, 20 aa, Artificial Sequence
  Synthetic construct
CHQSSSLPFTFGPGTKVDIK

SEQ ID NO: 293 - protein, 81 aa, Artificial Sequence
  Synthetic construct
QSIGTSLHWYQQRPDQSPMLLINYASQSISGVPSRFSGSGSGTDFTLTINSLEAEDAATYYCHQSSSLPFTFGPGTKVDIK

SEQ ID NO: 294 - protein, 20 aa, Artificial Sequence
  Synthetic construct
CHQSSSLPFTFGPGTKLDLK

SEQ ID NO: 295 - protein, 107 aa, Artificial Sequence
  Synthetic construct
EIVLTQSPDFQSVTPGEKVTITCRASQSIGTSLHWYQQGPDQSPMLLINYASQSISGVPSRFSGSGSGTDFTLTINSLEAEDAATYYCHQSSSLPFTFGPGTKVDIK

SEQ ID NO: 296 - protein, 107 aa, Artificial Sequence; identical to SEQ ID NO: 264
  Synthetic construct

SEQ ID NO: 297 - protein, 107 aa, Artificial Sequence; identical to SEQ ID NO: 275
  Synthetic construct

SEQ ID NO: 298 - protein, 107 aa, Artificial Sequence; identical to SEQ ID NO: 265
  Synthetic construct

SEQ ID NO: 299 - protein, 107 aa, Artificial Sequence
  Synthetic construct
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPFTFGPGTKVDIK

SEQ ID NO: 300 - protein, 107 aa, Artificial Sequence; identical to SEQ ID NO: 275
  Synthetic construct

SEQ ID NO: 301 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTEFTLTINSLEAEDAATYYCHQSSSLPFTFGPGTKVDIK

SEQ ID NO: 302 - protein, 107 aa, Artificial Sequence; identical to SEQ ID NO: 275
  Synthetic construct

SEQ ID NO: 303 - protein, 107 aa, Artificial Sequence; identical to SEQ ID NO: 275
  Synthetic construct

SEQ ID NO: 304 - protein, 107 aa, Artificial Sequence; identical to SEQ ID NO: 299
  Synthetic construct

SEQ ID NO: 305 - protein, 107 aa, Artificial Sequence; identical to SEQ ID NO: 275
  Synthetic construct

SEQ ID NO: 306 - protein, 107 aa, Artificial Sequence; identical to SEQ ID NO: 264
  Synthetic construct

SEQ ID NO: 307 - protein, 81 aa, Artificial Sequence
  Synthetic construct
QSIGSSLHWYQQKPDQSPKLLIKYASQSFSGVPSRFSGSGSGTDFTLTINSLEAEDAATYYCHQSSSLPFTFGPGTKVDIK

SEQ ID NO: 308 - protein, 107 aa, Artificial Sequence; identical to SEQ ID NO: 265
  Synthetic construct

SEQ ID NO: 309 - protein, 107 aa, Artificial Sequence; identical to SEQ ID NO: 272
  Synthetic construct

SEQ ID NO: 310 - protein, 107 aa, Artificial Sequence; identical to SEQ ID NO: 299
  Synthetic construct

SEQ ID NO: 311 - protein, 107 aa, Artificial Sequence; identical to SEQ ID NO: 265
  Synthetic construct

SEQ ID NO: 312 - protein, 107 aa, Artificial Sequence; identical to SEQ ID NO: 264
  Synthetic construct

SEQ ID NO: 313 - protein, 107 aa, Artificial Sequence; identical to SEQ ID NO: 265
  Synthetic construct

SEQ ID NO: 314 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFILTINSLEAEDAATYYCHQSSSLPFTFGPGTKVDIK

SEQ ID NO: 315 - protein, 107 aa, Artificial Sequence; identical to SEQ ID NO: 265
  Synthetic construct

SEQ ID NO: 316 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDAATYYCHQSSSLPFTFGPGTKVEIK

SEQ ID NO: 317 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTLTINSLEPEDAATYYCHQSSSLPFTFGPGTKVDIK

SEQ ID NO: 318 - protein, 107 aa, Artificial Sequence; identical to SEQ ID NO: 264
  Synthetic construct

SEQ ID NO: 319 - protein, 107 aa, Artificial Sequence; identical to SEQ ID NO: 264
  Synthetic construct

SEQ ID NO: 320 - protein, 20 aa, Artificial Sequence
  Synthetic construct
CHQSSSLPFTFGPGTKVDIK

SEQ ID NO: 321 - protein, 107 aa, Artificial Sequence; identical to SEQ ID NO: 265
  Synthetic construct

SEQ ID NO: 322 - protein, 107 aa, Artificial Sequence; identical to SEQ ID NO: 265
  Synthetic construct

SEQ ID NO: 323 - protein, 107 aa, Artificial Sequence
  Synthetic construct
EIVLTQSPDFQSVTPKERVTISCRASQSIGSSLHWLQQKRDQSPKLLIKYASQSISGVPSRFSGSGSETDFSLTINSLEAEDAATYFCHQSSSLPFTFGPGTKVDIK

SEQ ID NO: 324 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFILTINSLEAEDAATYYCHQSSSLPFTFGPGTKVDIK

SEQ ID NO: 325 - protein, 107 aa, Artificial Sequence; identical to SEQ ID NO: 265
  Synthetic construct

SEQ ID NO: 326 - protein, 107 aa, Artificial Sequence
  Synthetic construct
EIVPTQSPDFQSVTPGEKVTITCRASQSIGTSLHWYQQRPDQSPMLLINYASQSISGVPSRFSGSGSGTDFTLTINSLEAEDAAPYYCHQSSSLPFTFGPGTKVDIK

SEQ ID NO: 327 - protein, 81 aa, Artificial Sequence; identical to SEQ ID NO: 293
  Synthetic construct

SEQ ID NO: 328 - protein, 107 aa, Artificial Sequence; identical to SEQ ID NO: 275
  Synthetic construct

SEQ ID NO: 329 - protein, 58 aa, Artificial Sequence
  Synthetic construct
YASQSISGVPSRFSGSGSGTDFTLTINSLEAEDAATYYCHQSSSLPFTFGPGTKVDIK

SEQ ID NO: 330 - protein, 107 aa, Artificial Sequence
  Synthetic construct
EIVLTQSPDFQSVTPGEKVTITCRASQSIGTSLHWYQQRPDQSPMLLIKYASQSISGVPSRFSGSGSGTEFTLTINSLVAEDAATYYCHQSSSLPFTFGPGTKLDLK

SEQ ID NO: 331 - protein, 107 aa, Artificial Sequence
  Synthetic construct
EIVLTQSPDLQSVTPGEKVTITCRASQSIGTSLHWYQQRPDQSPMLLIKYASQSISGVPSRFSGSGSGTEFTLTINSLEAEDAATYYCHQSSSLPFTFGPGTKLDLK

SEQ ID NO: 332 - protein, 107 aa, Artificial Sequence; identical to SEQ ID NO: 265
  Synthetic construct

SEQ ID NO: 333 - protein, 107 aa, Artificial Sequence; identical to SEQ ID NO: 264
  Synthetic construct

SEQ ID NO: 334 - protein, 107 aa, Artificial Sequence
  Synthetic construct
EIVLTQSPDFQSVTPKEKVTITCRASQSIGSSLHWYQQKPDQFPKLLIKYASQSISGVPSRFSGSGSGTDFTLTINSLEAEDAATYYCHQSSSLPFTFGPGTKVDIK

SEQ ID NO: 335 - protein, 20 aa, Artificial Sequence
  Synthetic construct
CHQSSSLPFTFGPGTKVDIK

SEQ ID NO: 336 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDSATYYCHQSSSLPFTFGPGTKVDIK

SEQ ID NO: 337 - protein, 107 aa, Artificial Sequence; identical to SEQ ID NO: 265
  Synthetic construct

SEQ ID NO: 338 - protein, 107 aa, Artificial Sequence; identical to SEQ ID NO: 264
  Synthetic construct

SEQ ID NO: 339 - protein, 107 aa, Artificial Sequence; identical to SEQ ID NO: 264
  Synthetic construct

SEQ ID NO: 340 - protein, 78 aa, Artificial Sequence; identical to SEQ ID NO: 266
  Synthetic construct

SEQ ID NO: 341 - protein, 107 aa, Artificial Sequence
  Synthetic construct
EIVLTQSPDFQSVTPGEKVTITCRASQSIGTSLHWYQQRPDQSLMLLIKYASQSISGVPSRFSGSGSGTEFTLTINSLEAEDAATYYCHQSSSLPFTFGPGTKLDLK

SEQ ID NO: 342 - protein, 107 aa, Artificial Sequence
  Synthetic construct
EIVLTQSPDFQSVTPGEKVTITCRASQSIGTSLHWYQQRPDQSPMLLINYASQSISGVPSRFSDSGSGTDFTLTINSLEAEDAATYYCHQSSSLPFTFGPGTKVDIK

SEQ ID NO: 343 - protein, 107 aa, Artificial Sequence
  Synthetic construct
EIVLTQSPDFQSVTPGEKVTITCRASQSIGTSLHWYQQRPDQSPMLLINYASQSISGVPSRFSGSGSGTDFTLTINSLEAEDAATYYCHQSSSLPFTFGPGTKADIK

SEQ ID NO: 344 - protein, 107 aa, Artificial Sequence; identical to SEQ ID NO: 264
  Synthetic construct

SEQ ID NO: 345 - protein, 81 aa, Artificial Sequence
  Synthetic construct
QSIGTSLHWYQQRPDQSPMLLIKYASQSISGVPSRFSGSGSGTEFTLTINSLVAEDAATYYCHQSSSLPFTFGPGTKLDLK

SEQ ID NO: 346 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPWTFGPGTKVDIK

SEQ ID NO: 347 - protein, 107 aa, Artificial Sequence
  Synthetic construct
EIVLTQSPDFQSVTPKETVTITCRASQNIGLSLHWYQQKSDQPPELLIKYASQSLSGVPSRFSGSGSGTDFTLTINSLEPEDAATYHCHQTSSLPFTFGPGTKVDIK

SEQ ID NO: 348 - protein, 81 aa, Artificial Sequence
  Synthetic construct
QSIGSSLHWYQQKPDQSPKLLIKYASQSISGVPSRFSGSGSGTDFTLTINSLEAEDAATYYCHQSSSFSFTFGPGTKVDIK

SEQ ID NO: 349 - protein, 107 aa, Artificial Sequence
  Synthetic construct
EIVLTQTPDFQSVTPKEKVTITCRASQSIGSSLHWYQQKPDQSPKLLIKYASQSISGVPSRFSGSGSGTDFTLTINSLEAEDAATYYCHQSSSLPHTFGPGTKVDIK

SEQ ID NO: 350 - protein, 81 aa, Artificial Sequence
  Synthetic construct
QSIGTSLHWYQQRPDQSPMRLIKYASQSISGVPSRFSGSGSGTEFTLTINSLEAEDAATYYCHQSSSLPFAFGPGTKLDLK

SEQ ID NO: 351 - protein, 108 aa, Artificial Sequence
  Synthetic construct
DIVMTQSPDSLPVSLGERATINCKSSQSVLYTPNNKNYLAWYQQKPGQPPKLLIYWASIRQSGVPERFSGSGSGTDFTLTISSLQAEDVAVYYCQHFYSSPPTFGRGT

SEQ ID NO: 352 - protein, 113 aa, Artificial Sequence
  Synthetic construct
DIVMTQSPDSLAVSLGERATINCKSSQSVLYSPNNKNYLAWYQQRPGQPPKLLIYWASSRQSGVPDRFSGSGSGTDFTLTISSLQAEDVAVYYCQHFYSSPPTFGPGTTVAIK

SEQ ID NO: 353 - protein, 113 aa, Artificial Sequence
  Synthetic construct
DIVMTQSPDSLAVSLGERATINCKSSQSVIYSPKNKNYLAWYQQRPGQPPTLLIYWASSRQSGVPDRFSGSGSGTDFTLTISSLQAEDVAVYYCQHFYSSPPTFGPGATVAIK

SEQ ID NO: 354 - protein, 113 aa, Artificial Sequence; identical to SEQ ID NO: 352
  Synthetic construct

SEQ ID NO: 355 - protein, 113 aa, Artificial Sequence; identical to SEQ ID NO: 352
  Synthetic construct

SEQ ID NO: 356 - protein, 113 aa, Artificial Sequence; identical to SEQ ID NO: 352
  Synthetic construct

SEQ ID NO: 357 - protein, 113 aa, Artificial Sequence; identical to SEQ ID NO: 352
  Synthetic construct

SEQ ID NO: 358 - protein, 113 aa, Artificial Sequence; identical to SEQ ID NO: 352
  Synthetic construct

SEQ ID NO: 359 - protein, 113 aa, Artificial Sequence; identical to SEQ ID NO: 352
  Synthetic construct

SEQ ID NO: 360 - protein, 113 aa, Artificial Sequence
  Synthetic construct
DIVMTQSPDSLAVSLGERATINCKSSQSVLYSPNNKNYLAWYQQRPGQPPKLLIYWASSRQPGVPDRFSGSGSGTDFTLTISSLQAEDVAVYYCQHFYSSPPTFGPGTTVAIK

SEQ ID NO: 361 - protein, 113 aa, Artificial Sequence; identical to SEQ ID NO: 352
  Synthetic construct

SEQ ID NO: 362 - protein, 58 aa, Artificial Sequence
  Synthetic construct
WASSRQSGVPDRFSGSGSGTDFTLTISSLQAGDVAVYYCQHFYSSPPTFGPGTTVAIK

SEQ ID NO: 363 - protein, 113 aa, Artificial Sequence; identical to SEQ ID NO: 352
  Synthetic construct

SEQ ID NO: 364 - protein, 113 aa, Artificial Sequence; identical to SEQ ID NO: 352
  Synthetic construct

SEQ ID NO: 365 - protein, 113 aa, Artificial Sequence; identical to SEQ ID NO: 352
  Synthetic construct

SEQ ID NO: 366 - protein, 113 aa, Artificial Sequence; identical to SEQ ID NO: 352
  Synthetic construct

SEQ ID NO: 367 - protein, 113 aa, Artificial Sequence
  Synthetic construct
DIVMTQSPDSLAVSLGERATINCKSSQSILYSPNNKNYLAWYQQRPGQPPKLLIYWASSRQSGVPDRFSGSGSGTDFTLTISSLQAEDVAVYYCQHFYSSPPTFGPGTTVAIK

SEQ ID NO: 368 - protein, 113 aa, Artificial Sequence; identical to SEQ ID NO: 352
  Synthetic construct

SEQ ID NO: 369 - protein, 58 aa, Artificial Sequence
  Synthetic construct
WASSRQSGVPGRFSGSGSGTDFTLTISSLQAEDVAVYYCQHFYSSPPTFGPGTTVAIK

SEQ ID NO: 370 - protein, 58 aa, Artificial Sequence
  Synthetic construct
WASSRQSGVPDRFSGSGSGTDFTLTISSLQAEDVAVYYCQHFYSSPPTFGPGTTVAIK

SEQ ID NO: 371 - protein, 113 aa, Artificial Sequence
  Synthetic construct
DIVMNQSPDSLAVSLGERATINCKSSQSVLYSPNNKNYLAWYQQRPGQPPKLLIYWASSRQSGVPDRFSGSGSGTDFTLTISSLQAEDVAVYYCQHFYSSPPTFGPGTTVAIK

SEQ ID NO: 372 - protein, 113 aa, Artificial Sequence; identical to SEQ ID NO: 352
  Synthetic construct

SEQ ID NO: 373 - protein, 113 aa, Artificial Sequence
  Synthetic construct
DIVMTQSPDSLAVSLGERATINCKSSLSVLYSPNNKNYLAWYQQRPGQPPKLLIYWASSRQSGVPDRFSGSGSGTDFTLTISSLQAEDVAVYYCQHFYSSPPTFGPGTTVAIK

SEQ ID NO: 374 - protein, 113 aa, Artificial Sequence; identical to SEQ ID NO: 352
  Synthetic construct

SEQ ID NO: 375 - protein, 113 aa, Artificial Sequence
  Synthetic construct
DIVMTQSPDSLAVSLGERATINCKSSQSVLYSPNNKNYLAWYQQRPGQPPKLLIYWASARQSGVPDRFSGSGSGTDFTLTISSLQAEDVAVYYCQHFYSSPPTFGPGTTVAIK

SEQ ID NO: 376 - protein, 113 aa, Artificial Sequence; identical to SEQ ID NO: 352
  Synthetic construct

SEQ ID NO: 377 - protein, 113 aa, Artificial Sequence; identical to SEQ ID NO: 352
  Synthetic construct

SEQ ID NO: 378 - protein, 113 aa, Artificial Sequence
  Synthetic construct
DIVMAQSPDSLAVSLGARATINCKSSQSVLYSPNNKNYLAWYQQRPGQPPKLLIYWASSRQSGVPDRFSGSGSGTDVTLTISSLQAEDVAVYYCQHFYSSPPTFGPGTTVAIK

SEQ ID NO: 379 - protein, 113 aa, Artificial Sequence; identical to SEQ ID NO: 352
  Synthetic construct

SEQ ID NO: 380 - protein, 113 aa, Artificial Sequence; identical to SEQ ID NO: 352
  Synthetic construct

SEQ ID NO: 381 - protein, 113 aa, Artificial Sequence
  Synthetic construct
DIVMTQSPDSLAVSLGEGATINCKSSQSVLYSPNNKNYLAWYQQRPGQPPKLLIYWASSRQSGVPDRFSGSGSGTDFTLTISSLQAEDVAVYYCQHFYSSPPTFGPGTTVAIK

SEQ ID NO: 382 - protein, 113 aa, Artificial Sequence; identical to SEQ ID NO: 352
  Synthetic construct

SEQ ID NO: 383 - protein, 110 aa, Artificial Sequence
  Synthetic construct
DIVMTQSPDSLAVSLGERATINCKSSQSVLYSPNNKIYSAWYQQRPGQPPKLLIYWASSRQSGVPDRFSGSGSGTDFTLTISSLQAEDVAVYYCQHFYSSPPTFGPGTTV

SEQ ID NO: 384 - protein, 58 aa, Artificial Sequence
  Synthetic construct
WASSRQSGVPDRFSGSGSGTDFTPTISSLQAEDVAVYYCQHFYSSPPTFGPGTTVAIK

SEQ ID NO: 385 - protein, 113 aa, Artificial Sequence; identical to SEQ ID NO: 352
  Synthetic construct

SEQ ID NO: 386 - protein, 113 aa, Artificial Sequence; identical to SEQ ID NO: 352
  Synthetic construct

SEQ ID NO: 387 - protein, 113 aa, Artificial Sequence; identical to SEQ ID NO: 352
  Synthetic construct

SEQ ID NO: 388 - protein, 58 aa, Artificial Sequence; identical to SEQ ID NO: 370
  Synthetic construct

SEQ ID NO: 389 - protein, 113 aa, Artificial Sequence; identical to SEQ ID NO: 352
  Synthetic construct

SEQ ID NO: 390 - protein, 113 aa, Artificial Sequence; identical to SEQ ID NO: 352
  Synthetic construct

SEQ ID NO: 391 - protein, 113 aa, Artificial Sequence; identical to SEQ ID NO: 352
  Synthetic construct

SEQ ID NO: 392 - protein, 113 aa, Artificial Sequence
  Synthetic construct
DIVMTQSPDSLAASLGEGATINCESSQSVLHSSNNKNYLAWYQQKPGQPPKLLIYWASTRESGVPERFSGSGSGTDFTLTISSLQAEDVAVYYCQHFYSSPPTFGPGTTVAIK

SEQ ID NO: 393 - protein, 75 aa, Artificial Sequence
  Synthetic construct
LAWYQQRPGQPPKLLIYWASSRQSGVPDRFSGSGSGTDFTLTISSLQAEDVAVYYCQHFYSSPPTFGPGTTVAIK

SEQ ID NO: 394 - protein, 113 aa, Artificial Sequence; identical to SEQ ID NO: 352
  Synthetic construct

SEQ ID NO: 395 - protein, 113 aa, Artificial Sequence; identical to SEQ ID NO: 352
  Synthetic construct

SEQ ID NO: 396 - protein, 113 aa, Artificial Sequence; identical to SEQ ID NO: 352
  Synthetic construct

SEQ ID NO: 397 - protein, 113 aa, Artificial Sequence; identical to SEQ ID NO: 352
  Synthetic construct

SEQ ID NO: 398 - protein, 113 aa, Artificial Sequence; identical to SEQ ID NO: 352
  Synthetic construct

SEQ ID NO: 399 - protein, 113 aa, Artificial Sequence; identical to SEQ ID NO: 352
  Synthetic construct

SEQ ID NO: 400 - protein, 58 aa, Artificial Sequence; identical to SEQ ID NO: 370
  Synthetic construct

SEQ ID NO: 401 - protein, 113 aa, Artificial Sequence
  Synthetic construct
DIVMTQSPDSLAVSLGERATINCKSSQSVLYSPNNKNYLAWYQQRPGQPPKLLIYWASSRQSRVPDRFSGSGSGTDFTLTISSLQAEDVAVYYCQHFYSSPPTFGPGTTVAIK

SEQ ID NO: 402 - protein, 75 aa, Artificial Sequence; identical to SEQ ID NO: 393
  Synthetic construct

SEQ ID NO: 403 - protein, 113 aa, Artificial Sequence; identical to SEQ ID NO: 352
  Synthetic construct

SEQ ID NO: 404 - protein, 113 aa, Artificial Sequence; identical to SEQ ID NO: 352
  Synthetic construct

SEQ ID NO: 405 - protein, 113 aa, Artificial Sequence; identical to SEQ ID NO: 352
  Synthetic construct

SEQ ID NO: 406 - protein, 113 aa, Artificial Sequence; identical to SEQ ID NO: 352
  Synthetic construct

SEQ ID NO: 407 - protein, 113 aa, Artificial Sequence; identical to SEQ ID NO: 352
  Synthetic construct

SEQ ID NO: 408 - protein, 113 aa, Artificial Sequence; identical to SEQ ID NO: 352
  Synthetic construct

SEQ ID NO: 409 - protein, 58 aa, Artificial Sequence; identical to SEQ ID NO: 370
  Synthetic construct

SEQ ID NO: 410 - protein, 113 aa, Artificial Sequence; identical to SEQ ID NO: 352
  Synthetic construct

SEQ ID NO: 411 - protein, 110 aa, Artificial Sequence
  Synthetic construct
DIVMTQSPDSLAVSLGERATINCKSSQSVLYSPNNKNYLAWYQQRPGQPPKLLIYWASSRQSGVPDRFSGSGSGTDFTLTISSLQAEDVAVYYCQHFYSSPPTFGPGTTV

SEQ ID NO: 412 - protein, 113 aa, Artificial Sequence; identical to SEQ ID NO: 352
  Synthetic construct

SEQ ID NO: 413 - protein, 113 aa, Artificial Sequence
  Synthetic construct
DIVMTQSPDSLAVSLGERATINCKSSQSVLYSPNNKNYLAWYQQRPGQPPKLLIYWASSRQSGVPDRFSGSGSGTDFTLTISSQQAEDVAVYYCQHFYSSPPTFGPGTTVAIK

SEQ ID NO: 414 - protein, 113 aa, Artificial Sequence
  Synthetic construct
DIVMTQSPDSLAVSLGERATINCKSSQSVLYSPNNKNYLAWYQQRPGQPPKLLIYWASSRQSGVPDRFSGSGSGTGFTLTISSLQAEDVAVYYCQHFYSSPPTFGPGTTVAIK

SEQ ID NO: 415 - protein, 113 aa, Artificial Sequence; identical to SEQ ID NO: 352
  Synthetic construct

SEQ ID NO: 416 - protein, 113 aa, Artificial Sequence; identical to SEQ ID NO: 352
  Synthetic construct

SEQ ID NO: 417 - protein, 58 aa, Artificial Sequence; identical to SEQ ID NO: 370
  Synthetic construct

SEQ ID NO: 418 - protein, 113 aa, Artificial Sequence
  Synthetic construct
DIVMTQSPDSLAVSQGERATINCKSSQSVLYSPNNKNYLAWYQQRPGQPPKLLIYWASSRQSGVPDRFSGSGSGTDFTLTISSLQAEDVAVYYCQHFYSSPPTFGPGTTVAIK

SEQ ID NO: 419 - protein, 113 aa, Artificial Sequence; identical to SEQ ID NO: 352
  Synthetic construct

SEQ ID NO: 420 - protein, 113 aa, Artificial Sequence; identical to SEQ ID NO: 352
  Synthetic construct

SEQ ID NO: 421 - protein, 58 aa, Artificial Sequence; identical to SEQ ID NO: 370
  Synthetic construct

SEQ ID NO: 422 - protein, 113 aa, Artificial Sequence; identical to SEQ ID NO: 352
  Synthetic construct

SEQ ID NO: 423 - protein, 113 aa, Artificial Sequence
  Synthetic construct
DIVMTQSPDSLAVSLGERATINCKSSQSVLYSPNKKNYLAWYQQRPGQPPKLLIYWASSRQSGVPDRFSGSGSGTDFTLTISSLQAEDVAVYYCQHFYSSPPTFGPGTTVAIK

SEQ ID NO: 424 - protein, 113 aa, Artificial Sequence
  Synthetic construct
DIVMTQSPDSLAVSLGERATINCKSSQSILFSPNNKNYLAWYQQRPGQPPKLLIYWASSRQSGVPDRFSGSGSGTDFTLTISSLQAEDVGVYYCQHFYSSPPTFGPGTTVAIK

SEQ ID NO: 425 - protein, 113 aa, Artificial Sequence; identical to SEQ ID NO: 352
  Synthetic construct

SEQ ID NO: 426 - protein, 113 aa, Artificial Sequence; identical to SEQ ID NO: 352
  Synthetic construct

SEQ ID NO: 427 - protein, 75 aa, Artificial Sequence; identical to SEQ ID NO: 393
  Synthetic construct

SEQ ID NO: 428 - protein, 113 aa, Artificial Sequence; identical to SEQ ID NO: 352
  Synthetic construct

SEQ ID NO: 429 - protein, 113 aa, Artificial Sequence
  Synthetic construct
DIVMTQSPDSLAVSLGERATINCKSSQSVLYSPNNKNYLAWYQQGPGQPPKLLIYWASSRQSGVPDRFSGSGSGTDFTLTISSLQAEDVAVYYCQHFYSSPPTFGPGTTVAIK

SEQ ID NO: 430 - protein, 113 aa, Artificial Sequence
  Synthetic construct
DIVMTQSPDSLAVSLGERATINCKSSQSVLYSPNNKNYLAWYQQRPGQPPKLLIYWASSRQSGVPDRFSGSGSGTDFTLTISSLQAEDVAVNYCQHFYSSPPTFGPGTTVAIK

SEQ ID NO: 431 - protein, 113 aa, Artificial Sequence; identical to SEQ ID NO: 352
  Synthetic construct

SEQ ID NO: 432 - protein, 58 aa, Artificial Sequence; identical to SEQ ID NO: 370
  Synthetic construct

SEQ ID NO: 433 - protein, 113 aa, Artificial Sequence
  Synthetic construct
DIVMTQSPDSLAVTLGERATINCKSSQSVLYTSNNKNYLAWYQQKPGQPPKLLIYRASIRQSGVPDRFSGSGSETDFTLTISSLQAEDVAVYYCQHFYSNPPTFGPGTTVAIK

SEQ ID NO: 434 - protein, 112 aa, Artificial Sequence
  Synthetic construct
DIVMTQSPDSLAVSLGERATINCKSSQSVLYTSNNKNYLAWYQQKPGQPPKLLIYWASIRQSGVPDRFTGSWSETDFTLTISSLQAEDVAVYYCQHFYSNPPTFGPGTTVAI

SEQ ID NO: 435 - protein, 113 aa, Artificial Sequence
  Synthetic construct
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQHFYSNPPTFGPGTTVAIK

SEQ ID NO: 436 - protein, 113 aa, Artificial Sequence
  Synthetic construct
DIVMTQSPDSLAVSLGERATINCKSSQSLLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 437 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLSISSLQAEDVAVYYCQHFYSNPPTFGPGTTVAIK

SEQ ID NO: 438 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 439 - protein, 108 aa, Artificial Sequence
  Synthetic construct
DIVMTQSPDSLAVSLGERATINCKSSQSVLYTSNNKNYLAWDQQKPGQPPKLLIYWASIRQSGVPDRFSGSGSETDFTLTISSLQAEDVAVYYCQHFYSNPPTFGPGT

SEQ ID NO: 440 - protein, 113 aa, Artificial Sequence; identical to SEQ ID NO: 438
  Synthetic construct

SEQ ID NO: 441 - protein, 113 aa, Artificial Sequence
  Synthetic construct
DIVMTQSPDSLAVSLGERATINCKSSQSVLYTSNNQNYLAWYQQKPGQPPKLLIYWASIRQSGVPDRFSGSGSETDFTLTISSLQAEDVAVYYCQHFYSNPPTFGPGTTVAIK

SEQ ID NO: 442 - protein, 113 aa, Artificial Sequence; identical to SEQ ID NO: 438
  Synthetic construct

SEQ ID NO: 443 - protein, 113 aa, Artificial Sequence; identical to SEQ ID NO: 438
  Synthetic construct

SEQ ID NO: 444 - protein, 113 aa, Artificial Sequence; identical to SEQ ID NO: 438
  Synthetic construct

SEQ ID NO: 445 - protein, 113 aa, Artificial Sequence; identical to SEQ ID NO: 438
  Synthetic construct

SEQ ID NO: 446 - protein, 113 aa, Artificial Sequence; identical to SEQ ID NO: 438
  Synthetic construct

SEQ ID NO: 447 - protein, 108 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYSNPPTFGPGT

SEQ ID NO: 448 - protein, 108 aa, Artificial Sequence
  Synthetic construct
DIVMTQSPDSLAVSLGERATINCKSSQSVLYTSNNKNYIAWYQQKPGQPPKLLIYWASIRQSGVPDRFSGSGSETDFTLTISSLQAEDVAVYYCQHFYSNPPTFGPGT

SEQ ID NO: 449 - protein, 87 aa, Artificial Sequence
  Synthetic construct
QSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 450 - protein, 113 aa, Artificial Sequence; identical to SEQ ID NO: 438
  Synthetic construct

SEQ ID NO: 451 - protein, 113 aa, Artificial Sequence; identical to SEQ ID NO: 438
  Synthetic construct

SEQ ID NO: 452 - protein, 113 aa, Artificial Sequence; identical to SEQ ID NO: 435
  Synthetic construct

SEQ ID NO: 453 - protein, 113 aa, Artificial Sequence
  Synthetic construct
DIVMTQSPDSLAVSLGERATINCKSSQSVLYTSNNRNYLAWYQQKPGQPPKLLIYWASIRQSGVPDRFSGSGSETDFTLTISSLQAEDVAVYYCQHFYSNPPTFGPGTTVAIK

SEQ ID NO: 454 - protein, 108 aa, Artificial Sequence; identical to SEQ ID NO: 447
  Synthetic construct

SEQ ID NO: 455 - protein, 113 aa, Artificial Sequence; identical to SEQ ID NO: 438
  Synthetic construct

SEQ ID NO: 456 - protein, 113 aa, Artificial Sequence; identical to SEQ ID NO: 438
  Synthetic construct

SEQ ID NO: 457 - protein, 113 aa, Artificial Sequence; identical to SEQ ID NO: 438
  Synthetic construct

SEQ ID NO: 458 - protein, 113 aa, Artificial Sequence; identical to SEQ ID NO: 438
  Synthetic construct

SEQ ID NO: 459 - protein, 113 aa, Artificial Sequence; identical to SEQ ID NO: 438
  Synthetic construct

SEQ ID NO: 460 - protein, 75 aa, Artificial Sequence
  Synthetic construct
LTWYQQKPGQPPKLLIYWGSTRQSGVPARFSGSGSETDFTLTISSLQAEDVAVYYCQHFYSNPPTFGPGTTVAIK

SEQ ID NO: 461 - protein, 113 aa, Artificial Sequence
  Synthetic construct
DIVMTQSPDSLAVSLGERATINCKSSQSVLYTSNNKNYLAWYQQKPGQLPKLLIYWASIRQSGVPDRFSGSGSETDFTLTISSLQAEDVAVYYCQHFYSNPPTFGPGTTVAIK

SEQ ID NO: 462 - protein, 113 aa, Artificial Sequence; identical to SEQ ID NO: 438
  Synthetic construct

SEQ ID NO: 463 - protein, 113 aa, Artificial Sequence
  Synthetic construct
DIVMTQSPDSLAVSLGERATINCKSSQSVLYTYNNKNYLAWYQQKPGQPPKLLIYWASIRQSGVPDRFSGSGSETDFTLTISSLQAEDVAVYYCQHFYSNPPTFGPGTTVAIK

SEQ ID NO: 464 - protein, 113 aa, Artificial Sequence; identical to SEQ ID NO: 438
  Synthetic construct

SEQ ID NO: 465 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTRTISSLQAEDVAVYYCQHFYSNPPTFGPGTTVAIK

SEQ ID NO: 466 - protein, 113 aa, Artificial Sequence
  Synthetic construct
DVVMTQSPDSLAVSLGERATINCKSSQSVFDSSDKRNYLAWYQKKPGQPPKLIIYWASTRESGVPARFSGSGSGTDFTLTISSLQAEDVAVYYCQHFYSNPPTFGPGTTVAIK

SEQ ID NO: 467 - protein, 113 aa, Artificial Sequence
  Synthetic construct
DIVMTPSPDSLAVSLGERATINCKSSQSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 468 - protein, 113 aa, Artificial Sequence; identical to SEQ ID NO: 438
  Synthetic construct

SEQ ID NO: 469 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYFCQHFYSNPPTFGPGTTVAIK

SEQ ID NO: 470 - protein, 113 aa, Artificial Sequence; identical to SEQ ID NO: 438
  Synthetic construct

SEQ ID NO: 471 - protein, 113 aa, Artificial Sequence
  Synthetic construct
DIVMTQSPDSLAVSLGERATINCKSSQSVLYSSNNKNYLAWYQQKPGQPPKLLIYWASIRQSGVPDRFSGSGSETDFTLTISSLQAEDVAVYYCQHFYSNPPTFGPGTTVAIK

SEQ ID NO: 472 - protein, 108 aa, Artificial Sequence; identical to SEQ ID NO: 447
  Synthetic construct

SEQ ID NO: 473 - protein, 113 aa, Artificial Sequence; identical to SEQ ID NO: 438
  Synthetic construct

SEQ ID NO: 474 - protein, 113 aa, Artificial Sequence; identical to SEQ ID NO: 438
  Synthetic construct

SEQ ID NO: 475 - protein, 113 aa, Artificial Sequence; identical to SEQ ID NO: 438
  Synthetic construct

SEQ ID NO: 476 - protein, 58 aa, Artificial Sequence
  Synthetic construct
WASIRQSGVADRFSGSGSETDFTLTISSLQAEDVAVYYCQHFYSNPPTFGPGTTVAIK

SEQ ID NO: 477 - protein, 113 aa, Artificial Sequence; identical to SEQ ID NO: 438
  Synthetic construct

SEQ ID NO: 478 - protein, 53 aa, Artificial Sequence
  Synthetic construct
WASIRQSGVADRFSGSGSETDFTLTISSLQAEDVAVYYCQHFYSNPPTFGPGT

SEQ ID NO: 479 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSRSGSETDFTLTISSLQAEDVAVYYCQHFYSNPPTFGPGTTVAIK

SEQ ID NO: 480 - protein, 113 aa, Artificial Sequence; identical to SEQ ID NO: 438
  Synthetic construct

SEQ ID NO: 481 - protein, 108 aa, Artificial Sequence
  Synthetic construct
DIVMTQSPDSLAVSLGERATINCKSSQCVLYTSNNKNYLAWYQQKPGQPPKLLIYWASIRQSGVPDRFSGSGSETYFTLTISSLQAEDVAVYYCQHFYSNPPTFGPGT

SEQ ID NO: 482 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSVSETDFTLTISSLQAEDVAVYYCQHFYSNPPTFGPGTTVAIK

SEQ ID NO: 483 - protein, 113 aa, Artificial Sequence; identical to SEQ ID NO: 438
  Synthetic construct

SEQ ID NO: 484 - protein, 113 aa, Artificial Sequence
  Synthetic construct
DIVMTQSPDSLAVSLGERATINCKSSQSVLYTTNNKNYLAWYQQKPGQPPKLLIYWASIRQSGVPDRFSGSGSETDFTLTISSLQAEDVAVYYCQHFYSNPPTFGPGTTVAIK

SEQ ID NO: 485 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYCCQHFYSNPPTFGPGTTVAIK

SEQ ID NO: 486 - protein, 113 aa, Artificial Sequence
  Synthetic construct
DIVMTQSPDSLAVSLGKRATINCKSSQSVLYTSNNKNYLAWYQQKPGQPPKLLIYWASIRQSGVPDRFSGSGSETDFTLTISGLQAEDVAVYYCQHFYSNPPTFGPGTTVAIK

SEQ ID NO: 487 - protein, 58 aa, Artificial Sequence; identical to SEQ ID NO: 476
  Synthetic construct

SEQ ID NO: 488 - protein, 113 aa, Artificial Sequence; identical to SEQ ID NO: 438
  Synthetic construct

SEQ ID NO: 489 - protein, 113 aa, Artificial Sequence; identical to SEQ ID NO: 438
  Synthetic construct

SEQ ID NO: 490 - protein, 113 aa, Artificial Sequence
  Synthetic construct
DIVMTQSPDSLAVSLGERATINCKSSQSVLYNSNNKNYLAWYQQKPGQPPKLLIYWASIRQSGVPDRFSGSGSETDFTLTISSLQAEDVAVYYCQHFYSNPPTFGPGTTVAIK

SEQ ID NO: 491 - protein, 113 aa, Artificial Sequence
  Synthetic construct
DIVMTQSPDSLAVSLGERATINCKSSQSVLYTSNNKNYLAWYQQKPGQPPKLLSYWASIRQSGVPDRFSGSGSETDFTLTISSLQAEDVAVYYCQHFYSNPPTFGPGTTVAIK

SEQ ID NO: 492 - protein, 113 aa, Artificial Sequence
  Synthetic construct
DIVMTQSPDSLAVSLGERATINCKSSQSVLYTSNIKNYLAWYQQKPGQPPKLLIYWASIRQSGVPDRFSGSGSETDFTLTISSLQAEDVAVYYCQHFYSNPPTFGPGTTVAIK

SEQ ID NO: 493 - protein, 113 aa, Artificial Sequence; identical to SEQ ID NO: 438
  Synthetic construct

SEQ ID NO: 494 - protein, 113 aa, Artificial Sequence
  Synthetic construct
DIVMTQSPDSLAVSLGERATINCKSSQSVLYTSNNKNYLAWYQQRPGQPPKLLIYWASIRQSGVPDRFSGSGSETDFTLTISSLQAEDVAVYYCQHFYSNPPTFGPGTTVAIK

SEQ ID NO: 495 - protein, 113 aa, Artificial Sequence; identical to SEQ ID NO: 438
  Synthetic construct

SEQ ID NO: 496 - protein, 113 aa, Artificial Sequence; identical to SEQ ID NO: 438
  Synthetic construct

SEQ ID NO: 497 - protein, 113 aa, Artificial Sequence
  Synthetic construct
DFVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 498 - protein, 113 aa, Artificial Sequence; identical to SEQ ID NO: 438
  Synthetic construct

SEQ ID NO: 499 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEGVAVYYCQHFYSNPPTFGPGTTVAIK

SEQ ID NO: 500 - protein, 113 aa, Artificial Sequence
  Synthetic construct
DIVMTQSPDSLAVSLGERATINCKSSQSVLYTSNNKNYLAWYQQKPGQPPKLLIYWASIRQSGAPDRFSGSGSETDFTLTISSLQAEDVAVYYCQHFYSNPPTFGPGTTVAIK

SEQ ID NO: 501 - protein, 113 aa, Artificial Sequence; identical to SEQ ID NO: 438
  Synthetic construct

SEQ ID NO: 502 - protein, 108 aa, Artificial Sequence; identical to SEQ ID NO: 447
  Synthetic construct

SEQ ID NO: 503 - protein, 108 aa, Artificial Sequence; identical to SEQ ID NO: 447
  Synthetic construct

SEQ ID NO: 504 - protein, 113 aa, Artificial Sequence; identical to SEQ ID NO: 438
  Synthetic construct

SEQ ID NO: 505 - protein, 113 aa, Artificial Sequence; identical to SEQ ID NO: 438
  Synthetic construct

SEQ ID NO: 506 - protein, 113 aa, Artificial Sequence; identical to SEQ ID NO: 438
  Synthetic construct

SEQ ID NO: 507 - protein, 113 aa, Artificial Sequence
  Synthetic construct
DIVMTQSPDSLAVSLGERATINCKSSQSILYSFNNRNSLAWYQQKPGQPPKLLIYWASTRESGVPDRFSGSGSGTDFTLTISSLQAEDVAVYYCQHFYSNPPTFGPGTTVAIK

SEQ ID NO: 508 - protein, 108 aa, Artificial Sequence; identical to SEQ ID NO: 447
  Synthetic construct

SEQ ID NO: 509 - protein, 108 aa, Artificial Sequence; identical to SEQ ID NO: 447
  Synthetic construct

SEQ ID NO: 510 - protein, 113 aa, Artificial Sequence
  Synthetic construct
DIVMTQSPDSLAVFLGERATINCKSSQSVLYTSNNKNYLAWYQQKPGQPPKLLIYWASIRQSGVPDRFSGSRSETDFTLTISSLQAEDVAVYYCQHFYSNPPTFGPGTTVAIK

SEQ ID NO: 511 - protein, 113 aa, Artificial Sequence
  Synthetic construct
DIVLTQSPDSLALSLGERATINCKSSQTVLYSSNRKDYLAWYQQKPGQPPKLLIYWASTRESGVPDRFSGGGSGTDFTHTISNLQAEDVAVYYCQHFYSNPPTFGPGTTVAIK

SEQ ID NO: 512 - protein, 113 aa, Artificial Sequence
  Synthetic construct
DIVMTQSPDSLAVSLGARATINCKSSQSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 513 - protein, 113 aa, Artificial Sequence; identical to SEQ ID NO: 438
  Synthetic construct

SEQ ID NO: 514 - protein, 113 aa, Artificial Sequence; identical to SEQ ID NO: 438
  Synthetic construct

SEQ ID NO: 515 - protein, 113 aa, Artificial Sequence; identical to SEQ ID NO: 438
  Synthetic construct

SEQ ID NO: 516 - protein, 113 aa, Artificial Sequence; identical to SEQ ID NO: 438
  Synthetic construct

SEQ ID NO: 517 - protein, 113 aa, Artificial Sequence; identical to SEQ ID NO: 438
  Synthetic construct

SEQ ID NO: 518 - protein, 113 aa, Artificial Sequence; identical to SEQ ID NO: 438
  Synthetic construct

SEQ ID NO: 519 - protein, 113 aa, Artificial Sequence; identical to SEQ ID NO: 438
  Synthetic construct

SEQ ID NO: 520 - protein, 113 aa, Artificial Sequence
  Synthetic construct
DIVMTQSPDSLAVSLGERATINCKSSQSVLYTSNNKNYLARYQQKPGQPPKLLIYWASIRQSGVPDRFSGSGSETDFTLTISSLQAEDVAVYYCQHFYSNPPTFGPGTTVAIK

SEQ ID NO: 521 - protein, 113 aa, Artificial Sequence; identical to SEQ ID NO: 438
  Synthetic construct

SEQ ID NO: 522 - protein, 113 aa, Artificial Sequence; identical to SEQ ID NO: 438
  Synthetic construct

SEQ ID NO: 523 - protein, 113 aa, Artificial Sequence; identical to SEQ ID NO: 438
  Synthetic construct

SEQ ID NO: 524 - protein, 113 aa, Artificial Sequence
  Synthetic construct
DIVMTQSPDSLAVSLGERATINCKSNQSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 525 - protein, 113 aa, Artificial Sequence; identical to SEQ ID NO: 438
  Synthetic construct

SEQ ID NO: 526 - protein, 113 aa, Artificial Sequence; identical to SEQ ID NO: 438
  Synthetic construct

SEQ ID NO: 527 - protein, 113 aa, Artificial Sequence; identical to SEQ ID NO: 438
  Synthetic construct

SEQ ID NO: 528 - protein, 113 aa, Artificial Sequence; identical to SEQ ID NO: 438
  Synthetic construct

SEQ ID NO: 529 - protein, 113 aa, Artificial Sequence; identical to SEQ ID NO: 438
  Synthetic construct

SEQ ID NO: 530 - protein, 113 aa, Artificial Sequence; identical to SEQ ID NO: 438
  Synthetic construct

SEQ ID NO: 531 - protein, 113 aa, Artificial Sequence; identical to SEQ ID NO: 438
  Synthetic construct

SEQ ID NO: 532 - protein, 113 aa, Artificial Sequence
  Synthetic construct
DIVMTQSPDSLAVSLGEMATINCKSSQSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 533 - protein, 113 aa, Artificial Sequence; identical to SEQ ID NO: 438
  Synthetic construct

SEQ ID NO: 534 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEYVAVYYCQHFYSNPPTFGPGTTVAIK

SEQ ID NO: 535 - protein, 113 aa, Artificial Sequence; identical to SEQ ID NO: 438
  Synthetic construct

SEQ ID NO: 536 - protein, 113 aa, Artificial Sequence; identical to SEQ ID NO: 438
  Synthetic construct

SEQ ID NO: 537 - protein, 113 aa, Artificial Sequence; identical to SEQ ID NO: 438
  Synthetic construct

SEQ ID NO: 538 - protein, 113 aa, Artificial Sequence; identical to SEQ ID NO: 438
  Synthetic construct

SEQ ID NO: 539 - protein, 113 aa, Artificial Sequence; identical to SEQ ID NO: 438
  Synthetic construct

SEQ ID NO: 540 - protein, 113 aa, Artificial Sequence; identical to SEQ ID NO: 438
  Synthetic construct

SEQ ID NO: 541 - protein, 113 aa, Artificial Sequence; identical to SEQ ID NO: 438
  Synthetic construct

SEQ ID NO: 542 - protein, 113 aa, Artificial Sequence; identical to SEQ ID NO: 438
  Synthetic construct

SEQ ID NO: 543 - protein, 113 aa, Artificial Sequence; identical to SEQ ID NO: 438
  Synthetic construct

SEQ ID NO: 544 - protein, 113 aa, Artificial Sequence; identical to SEQ ID NO: 471
  Synthetic construct

SEQ ID NO: 545 - protein, 113 aa, Artificial Sequence; identical to SEQ ID NO: 438
  Synthetic construct

SEQ ID NO: 546 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLEAEDVAVYYCQHFYSNPPTFGPGTTVAIK

SEQ ID NO: 547 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRISGSGSVTAFTPTISSLQAEDVAVYYCQHFYSNPPTFGPGTTVAIK

SEQ ID NO: 548 - protein, 113 aa, Artificial Sequence
  Synthetic construct
DIVMTQSPDSLAVSLGERATINCKSSQSVLYTSNNKNYLAWYQQKPGQPPKLLFYWASIRQSGVPDRFSGSGSETDFTLTISSLQAEDVAVYYCQHFYSNPPTFGPGTTVAIK

SEQ ID NO: 549 - protein, 113 aa, Artificial Sequence; identical to SEQ ID NO: 438
  Synthetic construct

SEQ ID NO: 550 - protein, 113 aa, Artificial Sequence
  Synthetic construct
DIVMTQSPDSLAVSLGERATINCKSSQSVLYTSKNKNYLAWYQQKPGQPPKLLIYWASIRQSGVPDRFSGSGSETDFTLTISSLQAEDVAVYYCQHFYSNPPTFGPGTTVAIK

SEQ ID NO: 551 - protein, 113 aa, Artificial Sequence
  Synthetic construct
DIVMTQSPDSLAVSLGERATINCKSSQSVLYTSNNKNHLAWYQQKPGQPPKLLIYWASIRQSGVPDRFSGSGSETDFTLTISSLQAEDVAVYYCQHFYSNPPTFGPGTTVAIK

SEQ ID NO: 552 - protein, 113 aa, Artificial Sequence
  Synthetic construct
DIVMTQSPDSLAVSLGERATINCKSSQSVLYTSDNKNYLAWYQQKPGQPPKLLIYWASIRQSGVPDRFSGSGSETDFTLTISSLQAEDVAVYYCQHFYSNPPTFGPGTTVAIK

SEQ ID NO: 553 - protein, 113 aa, Artificial Sequence; identical to SEQ ID NO: 438
  Synthetic construct

SEQ ID NO: 554 - protein, 113 aa, Artificial Sequence
  Synthetic construct
DVVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYSNPPTFGPGTTVAIK

SEQ ID NO: 555 - protein, 113 aa, Artificial Sequence; identical to SEQ ID NO: 438
  Synthetic construct

SEQ ID NO: 556 - protein, 113 aa, Artificial Sequence
  Synthetic construct
DIVMIQSPDSLAVSLGERATINCKSSQSVLYTSNNKNYLAWYQQKPGQPPKLLIYSASIRQSGVPDRFSGSGSETDFTLTISSLQAEDVAVYYCQHFYSNPPTFGPGTTVAIK

SEQ ID NO: 557 - protein, 113 aa, Artificial Sequence
  Synthetic construct
DIVMTQSPDSLAVSLGERATINCKSSQSVLYTSNNKYYLAWYQQKPGQPPKLLIYWASIRQSGVPDRFSGSGSETDFTLTISSLQAEDVAVYYCQHLYSNPPTFGPGTTVAIK

SEQ ID NO: 558 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYSNPPTYGPGTTVAIK

SEQ ID NO: 559 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYTNPPTFGPGTTVAIK

SEQ ID NO: 560 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLAISSLQAEDVAVYYCQHFYTNPPTFGPGTTVAIK

SEQ ID NO: 561 - protein, 113 aa, Artificial Sequence
  Synthetic construct
DIVMTQSPDSPAVSLGERATINCKSSQSVLYTSNNKNYLAWYQQKPGQPPKLLIYWASIRQSGVPDRFSGSGSETDFTLTISSLQAEDVAVYYCQHFYTNPPTFGPGTTVAIK

SEQ ID NO: 562 - protein, 113 aa, Artificial Sequence; identical to SEQ ID NO: 559
  Synthetic construct

SEQ ID NO: 563 - protein, 108 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYTNPPTFGPGT

SEQ ID NO: 564 - protein, 113 aa, Artificial Sequence
  Synthetic construct
DIVMTQSPDSLAVSLGERATINCKSSQSVLYTSNNKNYFAWYQQKPGQPPKLLIYWASIRQSGVPDRFSGSGSETDFTLTISSLQAEDVAVYYCQHFYTNPPTFGPGTTVAIK

SEQ ID NO: 565 - protein, 113 aa, Artificial Sequence
  Synthetic construct
DIVMTQSPDSLAVSLGEGATINCKSSQSVLYTSNNKNYLAWYQQKPGQPPKLLIYWASIRQSGVPDRFSGSGSETDFTLTISSLQAEDVAVYYCQHFYTNPPTFGPGTTVAIK

SEQ ID NO: 566 - protein, 113 aa, Artificial Sequence; identical to SEQ ID NO: 559
  Synthetic construct

SEQ ID NO: 567 - protein, 113 aa, Artificial Sequence; identical to SEQ ID NO: 559
  Synthetic construct

SEQ ID NO: 568 - protein, 113 aa, Artificial Sequence; identical to SEQ ID NO: 559
  Synthetic construct

SEQ ID NO: 569 - protein, 113 aa, Artificial Sequence; identical to SEQ ID NO: 559
  Synthetic construct

SEQ ID NO: 570 - protein, 113 aa, Artificial Sequence
  Synthetic construct
DIVMTQSPDSLAVSLGERATINCKSSQSVLYTSNNKNYLAWYQQKPGQPPKLLIYWVSIRQSGVPDRFSGSGSETDFTLTISSLQAEDVAVYYCQHFYTNPPTFGPGTTVAIK

SEQ ID NO: 571 - protein, 113 aa, Artificial Sequence
  Synthetic construct
DIVMTQSPDSLAVSLGERATINCKSSQSVLYTSNNKNYLAWYQQKPGQPPKLLIYWASIRQCGVPDRFSGSGSETDFTLTISSLQAEDVAVYYCQHFYTNPPTFGPGTTVAIK

SEQ ID NO: 572 - protein, 113 aa, Artificial Sequence; identical to SEQ ID NO: 559
  Synthetic construct

SEQ ID NO: 573 - protein, 113 aa, Artificial Sequence; identical to SEQ ID NO: 559
  Synthetic construct

SEQ ID NO: 574 - protein, 113 aa, Artificial Sequence
  Synthetic construct
DIAMTQSPDSLAVSLGERATINCKSSQSVLYTSKNKNYLAWYQQKPGQPPKLLIYWASIRQSGVPDRFSGSGSETDFTLTISSLQAEDVAVYYCQHFYSDPPTFGPGTTVAIK

SEQ ID NO: 575 - protein, 113 aa, Artificial Sequence
  Synthetic construct
DIVMTQSPDSLAVSLGERATINCKSSQSVLYTSNNKNYLAWYQQKPGQPPKLLIYWASIRQSGVPDRFSGSGSETDFTLTISSLQAEDVAVYYCQHFYSKPPTFGPGTTVAIK

SEQ ID NO: 576 - protein, 112 aa, Artificial Sequence; identical to SEQ ID NO: 119
  Synthetic construct

SEQ ID NO: 577 - protein, 85 aa, Artificial Sequence
  Synthetic construct
SLLHNNEHNYLDWYLQKPGQSPQLLIYLGSNRASGVPDRFSGSGSGTDFTLKISRVEAEDVGIYYCMQPLQTPRTFGQGTKVDIK

SEQ ID NO: 578 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQPLQTPRTFGQGTRLEIK

SEQ ID NO: 579 - protein, 85 aa, Artificial Sequence
  Synthetic construct
SLLHNNEHNYLDWYLQKPGQSPQLLIYLASNRASGVPDRFSGSGSGTDFTLKISRVEAEDVGIYYCMQPLQTPRTFGQGTKVDIK

SEQ ID NO: 580 - protein, 86 aa, Artificial Sequence
  Synthetic construct
QSLLHRNGCNYLHWYLQKPGQSPQLLIYLGSNRASGVPDRFSGSGSGTDFTLKISRVEAEDIGVYYCMQPLQTPRTFGQGTKLEIK

SEQ ID NO: 581 - protein, 112 aa, Artificial Sequence
  Synthetic construct
DIVLTQSPLSLPVTPGEPASISCRSSQSLLSNNGYNYLDWYLQRPGQSPQLLIYLGSNRASGVPDRFSGSGSGTDFTLKISRVEAEDVGVYYCMQPLQTPRTFGQGTRLEIK

SEQ ID NO: 582 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQPLQTPRTFGQGTKLEIK

SEQ ID NO: 583 - protein, 112 aa, Artificial Sequence
  Synthetic construct
DIVLTQSPLSLPVTPGEPASISCRSSQSLLNSNGYNYLDWYLQKPGQSPQLLIYLGSNRASGVPDRFSGSGPGTDFTLKIRRVEAEDVGVYYCMQPLQTPRTFGQGTRLEIK

SEQ ID NO: 584 - protein, 112 aa, Artificial Sequence
  Synthetic construct
DIVLTQSPLSLPVTPGEPTSISCRSSQSLLHSNRYNYLDWYLQRPGQSPQLLIYLGSNRASGVPDRFSGSGSGTDFTLKISRVEAEDVGIYYCMQPLQTPGTFGQGIKVEIK

SEQ ID NO: 585 - protein, 112 aa, Artificial Sequence
  Synthetic construct
DIMMIQSPLSLPVTPGEPASISCRSSESLLHSSGYNYLGWYVQKPGQSPQLLIYLASNRASGVPDRFNGSGSGTDFTLRISRVEAEDVGVYYCMQPLQRPCTFGQGTRLEIK

SEQ ID NO: 586 - protein, 112 aa, Artificial Sequence
  Synthetic construct
DIVMTQSPLSLPVTPGEPASISCRSSQSLLHSNGNNYLDWYLQKPGQSPQLLIYLGSNRASGVPDRFSGSGSGTDFTLKISRVEAEDVGVYYCMQPLQTPKTFGQGTKVEIK

SEQ ID NO: 587 - protein, 86 aa, Artificial Sequence
  Synthetic construct
QSLLHSNGYNYLDWYLQKPGQSPQLLIYLGSNRVSGVPDRFSGSGSGTDFTLKISRVEAEDVGVYYCMQPLQTPKTFGQGTKVEIK

SEQ ID NO: 588 - protein, 112 aa, Artificial Sequence
  Synthetic construct
DIVMTQSPLSLPVTPGESASISCRSSQSLLHSNGNNYLDWYLQKPGQSPQLLIYLGSNRASGVPDRFSGSGSGTDFTLKISRVEAEDVGVYYCMQPLQTPKTFGQGTKVEIK

SEQ ID NO: 589 - protein, 86 aa, Artificial Sequence; identical to SEQ ID NO: 587
  Synthetic construct

SEQ ID NO: 590 - protein, 112 aa, Artificial Sequence; identical to SEQ ID NO: 121
  Synthetic construct

SEQ ID NO: 591 - protein, 112 aa, Artificial Sequence; identical to SEQ ID NO: 122
  Synthetic construct

SEQ ID NO: 592 - protein, 112 aa, Artificial Sequence; identical to SEQ ID NO: 122
  Synthetic construct

SEQ ID NO: 593 - protein, 112 aa, Artificial Sequence; identical to SEQ ID NO: 124
  Synthetic construct

SEQ ID NO: 594 - protein, 86 aa, Artificial Sequence
  Synthetic construct
QSLLHSNGYNYLDWYLQKPGQPPQLLIYLGSNRASGVPDGFSGSGSGTDFTLKISRVEAEDVGVYYCMQPLQIPGTFGQGTKVEIK

SEQ ID NO: 595 - protein, 86 aa, Artificial Sequence
  Synthetic construct
QSLLHSNGYTYLDWYLQKPGQSPQLLIYSGSNRASGVPDWFSGSGSGTDFTLKISRVEAEDVGVYYCMQPLQVPQTFGQGTKVEIK

SEQ ID NO: 596 - protein, 112 aa, Artificial Sequence
  Synthetic construct
DIVMTQSPLSLPVTPGEPASISCRSSQSLLHSNGYNYLDWYLQKPGQSPQLLIYLGSHRASGVPDRFSGSASGRDFTLKISRVEAEDVGVYYCMQPLQTPHTFGQGTKLEIK

SEQ ID NO: 597 - protein, 112 aa, Artificial Sequence
  Synthetic construct
DIVMTQSPLSLPVTPGEPASISCRSSQSLLHSNGYNYLDWYLQKPGQSPQLLIYLGSNWASGVPDRFSGSGSGTDFTLKISRVEAEDVGVYYCMPPLQTPYTFGQGTKLEIK

SEQ ID NO: 598 - protein, 109 aa, Artificial Sequence
  Synthetic construct
DIVMTQSPLSLPVIPGEPASISCRSSQSLLHSNGYNYLDWYLQKPGQSPQLLIYLGSNRASGVPDRFSGGGSGTDFTLKISRVEAEDVGVYYCMQPLQIPTTFGQGTKV

SEQ ID NO: 599 - protein, 109 aa, Artificial Sequence
  Synthetic construct
EIVMTQSPLSLPVTPGEPASISCRSSQSLLYSNGYNYLDWYVQKPGQSPHLLIYFASYRASGVPDRFSGSGSGTNFTLKISRVEAEDVGVYYCMQPLQIPTTFGQGTKV

SEQ ID NO: 600 - protein, 111 aa, Artificial Sequence
  Synthetic construct
DIVLTQSPLSLPVTPGEPASISCRSSQSLLHSNGYNYLHWYLQKPGQSPQLLICLGSNRASGVPDRFSGSGSGTSFTLKISRVEAEDVGVYYCKQPLQHPYTFGQGTKLEI

SEQ ID NO: 601 - protein, 111 aa, Artificial Sequence
  Synthetic construct
DIVLTQSPLSLPVTPGEPASISCRSSQSLLHSNGYNYLHWYLQKPGQSPQLLIYLGSNRASGVPDRFSGSGSGTSFTLKISRVEAEDVGVYYCKQPLQHPYTFGQGTKLEI

SEQ ID NO: 602 - protein, 112 aa, Artificial Sequence
  Synthetic construct
DIVMTQSPLSLPVAPGEPASISCRSSQSLLHSNGYNYLDWYLQKPGQSPQLLIYLGSNRASGVPDRVSGSGSGTDFTLKISRVEAEDVGVYYCMQFLQHPYTFGQGTKLEIK

SEQ ID NO: 603 - protein, 112 aa, Artificial Sequence; identical to SEQ ID NO: 223
  Synthetic construct

SEQ ID NO: 604 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDFGVYYCMQPLQTPYTFGQGTKLEIK

SEQ ID NO: 605 - protein, 112 aa, Artificial Sequence
  Synthetic construct
DIVMTQSPFSLPVTPGEPASISCRSSQSLLHSNGYNYLDWYLQKPGQSPQLLIYLGSNRASGVPDRFSGSGSGTDFTLKISRVEAEDVGVYYCMQPLQTPYTFGQGTKLEIK

SEQ ID NO: 606 - protein, 86 aa, Artificial Sequence
  Synthetic construct
QSLLHNNGYNYLAWYLQKPGQSPQLLIYLGSNRASGVHDRFSGSGSGTDFTLKISRVKAEDVGVYYCMQPLQTPYTFGQGTKLEIK

SEQ ID NO: 607 - protein, 112 aa, Artificial Sequence
  Synthetic construct
DIVMTQSPLSLPVTPGEPASISCRSSQSLLHNDGYNYLAWYLQKPGQSPQLLIYLGSNRASGVPDRFSGSGSGTDFTLKISRVKAEDVGVYYCMQPLQTPYTFGQGTKLEIK

SEQ ID NO: 608 - protein, 112 aa, Artificial Sequence
  Synthetic construct
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQPLQTPYTFGQGTKLEIK

SEQ ID NO: 609 - protein, 112 aa, Artificial Sequence
  Synthetic construct
DIVMTQSPLSLPVTPGEPASISCRSSQSLLHNNGYNYLAWYLQKPGQSPQLLIYLGSNRASGVPDRFSGSGSGTDFTLKISRVKAEDVGVYYCMQPLQTPYTFGQGTKLEIK

SEQ ID NO: 610 - protein, 112 aa, Artificial Sequence
  Synthetic construct
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQPLQTPYTFGQGTKLEIK

SEQ ID NO: 611 - protein, 112 aa, Artificial Sequence; identical to SEQ ID NO: 604
  Synthetic construct

SEQ ID NO: 612 - protein, 112 aa, Artificial Sequence
  Synthetic construct
DIVMTKSPLSLPVTPGEPASISCRSSQSLLHSNGYNYLDWYLQKPGQSPQLLIYLGSNRASGVPDRFSGSGSGTDFTLKISRVEAEDFGVYYCMQPLQTPYTFGQGTKLEIK

SEQ ID NO: 613 - protein, 112 aa, Artificial Sequence
  Synthetic construct
DIVMTQSPLSLPVTPGEPASISCRSSQSLLHTSGYNYLDWYLQKPGQSPQLLIYLGSNRASGVPDRFSGSGSGTDFTLNISRVEPEDVGVYYCMQPLQTPYTFGQGTKLEIK

SEQ ID NO: 614 - protein, 111 aa, Artificial Sequence
  Synthetic construct
EIVMRQSPLSLPVTPGEAASISCRSSQSLLHGNGHNYLDWYLQKPGQSPQLLIYLGSNRASGVPERFSGSGSGTDFTLKISRVEAEDVGLYYCMQPLQTPYTFGQGTRLEI

SEQ ID NO: 615 - protein, 112 aa, Artificial Sequence
  Synthetic construct
DIVMTQSPLSLAVTPGEPASISCRSSQSLLHSNGNNYLDWYLQRPGQSPQLLIYLGSNRASGVPDRFSGSGSDTEFTLKITRVEAEDVGFYYCMQPLQTPYTFGQGTKLEIK

SEQ ID NO: 616 - protein, 112 aa, Artificial Sequence; identical to SEQ ID NO: 604
  Synthetic construct

SEQ ID NO: 617 - protein, 112 aa, Artificial Sequence; identical to SEQ ID NO: 609
  Synthetic construct

SEQ ID NO: 618 - protein, 112 aa, Artificial Sequence
  Synthetic construct
DIVKTQSPLSLPVTPGEPASISCRSSQSLLHSNGYNYLDWYLQKPGQSPQLLIYLGSNRASGVPDRFSGSGSGTDFTLKISRVEAEDFGVYYCMQPLQTPYTFGQGTKLEIK

SEQ ID NO: 619 - protein, 112 aa, Artificial Sequence
  Synthetic construct
DIVMTQSPLSLPVTPGEPASISCRSSQGLLHSNGYNYLDWYLQKPGQSPQLLIYLGSNRASGVPDRFSGSGSGTDFTLKISRVEAEDFGVYYCMQPLQTPYTFGQGTKLEIK

SEQ ID NO: 620 - protein, 112 aa, Artificial Sequence; identical to SEQ ID NO: 604
  Synthetic construct

SEQ ID NO: 621 - protein, 112 aa, Artificial Sequence; identical to SEQ ID NO: 604
  Synthetic construct

SEQ ID NO: 622 - protein, 112 aa, Artificial Sequence; identical to SEQ ID NO: 609
  Synthetic construct

SEQ ID NO: 623 - protein, 112 aa, Artificial Sequence; identical to SEQ ID NO: 609
  Synthetic construct

SEQ ID NO: 624 - protein, 112 aa, Artificial Sequence
  Synthetic construct
DIVMTQSPLSLPVTPGEPASISCRSSQSLLHNNGYNYLAWYLQKPGQSPQLLIYLGSNRASGVPDRFSGSGSGTDFTLKISRMKAEDVGVYYCMQPLQTPYTFGQGTKLEIK

SEQ ID NO: 625 - protein, 112 aa, Artificial Sequence; identical to SEQ ID NO: 609
  Synthetic construct

SEQ ID NO: 626 - protein, 112 aa, Artificial Sequence; identical to SEQ ID NO: 604
  Synthetic construct

SEQ ID NO: 627 - protein, 20 aa, Artificial Sequence
  Synthetic construct
CMQPLQTPYTFGQGTKLEIK

SEQ ID NO: 628 - protein, 112 aa, Artificial Sequence
  Synthetic construct
DIVVTQSPLSLPVTPGEPASISCRSSQSLLHSNGYNYLDWYLQKPGQSPQLLIYLGSNRASGVPDRFSGSGSGTDFTLKISRVEAEDFGVYYCMQPLQTPYTFGQGTKLEIK

SEQ ID NO: 629 - protein, 112 aa, Artificial Sequence; identical to SEQ ID NO: 609
  Synthetic construct

SEQ ID NO: 630 - protein, 20 aa, Artificial Sequence
  Synthetic construct
CMQPLQTPYTFGQGTKLEIK

SEQ ID NO: 631 - protein, 112 aa, Artificial Sequence; identical to SEQ ID NO: 609
  Synthetic construct

SEQ ID NO: 632 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLTISRVEAEDFGVYYCMQPLQTPYTFGQGTKLEIK

SEQ ID NO: 633 - protein, 86 aa, Artificial Sequence
  Synthetic construct
QSLLHNNGYNYLAWYLQKPGQSPQLLIYLGSNRASGVPDRFSGSGSGTDFTLKISRVKAEDVGVYYCMQPLQTPYTFGQGTKLEIK

SEQ ID NO: 634 - protein, 112 aa, Artificial Sequence; identical to SEQ ID NO: 609
  Synthetic construct

SEQ ID NO: 635 - protein, 112 aa, Artificial Sequence; identical to SEQ ID NO: 604
  Synthetic construct

SEQ ID NO: 636 - protein, 112 aa, Artificial Sequence; identical to SEQ ID NO: 609
  Synthetic construct

SEQ ID NO: 637 - protein, 112 aa, Artificial Sequence; identical to SEQ ID NO: 609
  Synthetic construct

SEQ ID NO: 638 - protein, 112 aa, Artificial Sequence
  Synthetic construct
DIVMTQSPLSLPVTPGEPASISCRSSQSLLHNNGYNYLAWYLQKPGQSPQLLIYLGSNRASGVPDRFSGSGSGTAFTLKISRVKAEDVGVYYCMQPLQTPYTFGQGTKLEIK

SEQ ID NO: 639 - protein, 112 aa, Artificial Sequence; identical to SEQ ID NO: 609
  Synthetic construct

SEQ ID NO: 640 - protein, 112 aa, Artificial Sequence; identical to SEQ ID NO: 604
  Synthetic construct

SEQ ID NO: 641 - protein, 112 aa, Artificial Sequence; identical to SEQ ID NO: 609
  Synthetic construct

SEQ ID NO: 642 - protein, 112 aa, Artificial Sequence
  Synthetic construct
DIVMTQSPLSLPVTPGEPASISCRSSQSLLHSNGYKYLDWYLQKPGQSPQLLIYLGSNRASGVPDRFSGSGSGTDFTLKISRVEAEDVGVYYCMQPLQTPYTFGQGTKLEIK

SEQ ID NO: 643 - protein, 112 aa, Artificial Sequence; identical to SEQ ID NO: 609
  Synthetic construct

SEQ ID NO: 644 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQPLQTPYTFGQGTKLEIK

SEQ ID NO: 645 - protein, 112 aa, Artificial Sequence; identical to SEQ ID NO: 609
  Synthetic construct

SEQ ID NO: 646 - protein, 112 aa, Artificial Sequence; identical to SEQ ID NO: 604
  Synthetic construct

SEQ ID NO: 647 - protein, 112 aa, Artificial Sequence
  Synthetic construct
DIVMTQSPLSLPVTPGEPASISCRSSQSLLHNNGYNYLAWYLQKPGQSPQLLFYLGSNRASGVPDRSSGSGSGTDFTLKISRVKAEDVGVYYCMQPLQTPYTFGQGTKLEIK

SEQ ID NO: 648 - protein, 112 aa, Artificial Sequence
  Synthetic construct
DIVMTQSPLSLPVTPGEPASISCRSSQSPLHSNGYNYLDWYLQKPGQSPQLLIHLGSNRASGVPARFSGSGSGTDFTLKISRVEAEDFGVYYCMQPLQTPYTFGQGTKLEIK

SEQ ID NO: 649 - protein, 112 aa, Artificial Sequence; identical to SEQ ID NO: 609
  Synthetic construct

SEQ ID NO: 650 - protein, 58 aa, Artificial Sequence
  Synthetic construct
LGSNRASGVPDRFSGSGSGTDFTLKISRVKAEDVGVYYCMQPLQTPYTFGQGTKLEIK

SEQ ID NO: 651 - protein, 112 aa, Artificial Sequence; identical to SEQ ID NO: 604
  Synthetic construct

SEQ ID NO: 652 - protein, 112 aa, Artificial Sequence; identical to SEQ ID NO: 604
  Synthetic construct

SEQ ID NO: 653 - protein, 112 aa, Artificial Sequence; identical to SEQ ID NO: 609
  Synthetic construct

SEQ ID NO: 654 - protein, 112 aa, Artificial Sequence; identical to SEQ ID NO: 604
  Synthetic construct

SEQ ID NO: 655 - protein, 112 aa, Artificial Sequence; identical to SEQ ID NO: 609
  Synthetic construct

SEQ ID NO: 656 - protein, 20 aa, Artificial Sequence
  Synthetic construct
CMQPLQTPYTFGQGTKLEIK

SEQ ID NO: 657 - protein, 112 aa, Artificial Sequence; identical to SEQ ID NO: 609
  Synthetic construct

SEQ ID NO: 658 - protein, 112 aa, Artificial Sequence
  Synthetic construct
DVVMTQSPLSLPVTLGQPASISCRSSQSLVHSDGNTYLNWFQQRPGQSPRRLIYKVSNRDSGVPDRFSGSGSGTDFTLKISRVEAEDFGVYYCMQPLQTPYTFGQGTKLEIK

SEQ ID NO: 659 - protein, 112 aa, Artificial Sequence; identical to SEQ ID NO: 609
  Synthetic construct

SEQ ID NO: 660 - protein, 112 aa, Artificial Sequence
  Synthetic construct
DIVMTQSPLSLPVTPGEPASISCRSSQSLLHNNGYNYLDWYLQKPGQFPQLLIYLGSNRASGVPDRFSGSGSGSDFTLKISRVEAEDVGVYYCMQPLQTPYTFGQGTKLEIK

SEQ ID NO: 661 - protein, 112 aa, Artificial Sequence; identical to SEQ ID NO: 609
  Synthetic construct

SEQ ID NO: 662 - protein, 112 aa, Artificial Sequence; identical to SEQ ID NO: 604
  Synthetic construct

SEQ ID NO: 663 - protein, 112 aa, Artificial Sequence; identical to SEQ ID NO: 609
  Synthetic construct

SEQ ID NO: 664 - protein, 112 aa, Artificial Sequence; identical to SEQ ID NO: 609
  Synthetic construct

SEQ ID NO: 665 - protein, 112 aa, Artificial Sequence; identical to SEQ ID NO: 609
  Synthetic construct

SEQ ID NO: 666 - protein, 112 aa, Artificial Sequence; identical to SEQ ID NO: 609
  Synthetic construct

SEQ ID NO: 667 - protein, 112 aa, Artificial Sequence
  Synthetic construct
DIVMTQSPLSLPVTPGEPASISCRPSQSLLHSNGYNYLDWYLQKPGQSPQLLIYLGSNRASGVPDRFSGSGSGTDFTLKISRVEAEDFGVYYCMQPLQTPYTFGQGTKLEIK

SEQ ID NO: 668 - protein, 112 aa, Artificial Sequence; identical to SEQ ID NO: 609
  Synthetic construct

SEQ ID NO: 669 - protein, 86 aa, Artificial Sequence
  Synthetic construct
QSLLHSNGYNYLDWYLQKPGQSPQLLIYLGSNRASGVPDRFSGSGSGTDFTLKISRVEAEDFGVYYCMQPLQTPYTFGQGTKLEIK

SEQ ID NO: 670 - protein, 111 aa, Artificial Sequence
  Synthetic construct
EILMRQSPLSLPVTPGEAASISCRSSQSLLHGNGHNYLDWYLQKPGQSPQLLIYLGSNRASGVPERFSGSGSGTDFTLKISRVEAEDVGLYYCMQPLQTPYTFGQGTRLEI

SEQ ID NO: 671 - protein, 112 aa, Artificial Sequence
  Synthetic construct
DIMMTQSLLSLPVTPGEPASISCRSSQSLLHNNGYNYLAWYLQKPGQSPQLLIYLGSNRASGVPDRFSGSGSGTDFTLKISRVKAEDVGVYYCMQPLQTPYTFGQGTKLEIK

SEQ ID NO: 672 - protein, 86 aa, Artificial Sequence; identical to SEQ ID NO: 669
  Synthetic construct

SEQ ID NO: 673 - protein, 112 aa, Artificial Sequence
  Synthetic construct
DIVMTQSPLSLPVTPGEPASFSCRSSQSLLHNNGYNYLAWYLQKPGQSPQLLIYLGSNRASGVPDRFSGSGSGTDFTLKISRVKAEDVGVYYCMQPLQTPYTFGQGTKLEIK

SEQ ID NO: 674 - protein, 112 aa, Artificial Sequence
  Synthetic construct
DIVMTQSPLSLPVTPGEPASISCRSSQSLLHSNGYNYLDWYLQKPGQSPQLLIYLSSNRASGVPDRFSGSGSGTDFTLKISRVEAEDVGIYYCMQPLQTPYTFGQGTKLEIK

SEQ ID NO: 675 - protein, 112 aa, Artificial Sequence; identical to SEQ ID NO: 604
  Synthetic construct

SEQ ID NO: 676 - protein, 112 aa, Artificial Sequence; identical to SEQ ID NO: 613
  Synthetic construct

SEQ ID NO: 677 - protein, 58 aa, Artificial Sequence; identical to SEQ ID NO: 650
  Synthetic construct

SEQ ID NO: 678 - protein, 20 aa, Artificial Sequence
  Synthetic construct
CMQPLQTPYTFGQGTKLEIK

SEQ ID NO: 679 - protein, 112 aa, Artificial Sequence
  Synthetic construct
DIVMTQSPLSLPVTPGEPASISCRSSQSLLHSNGYNYLDWYLQKPGQSPQLLIYLGSNRASGVPDRFSGSGSATDFTLKISRVEAEDVGVYYCMQPLQTPYTFGQGTKLEIK

SEQ ID NO: 680 - protein, 112 aa, Artificial Sequence
  Synthetic construct
DIVMTRSPLSLPVTPGEPASISCRSSQSLLHNNGYNYLAWYLQKPGQSPQLLIYLGSNRASGVPDRFSGSGSGTDFTLKISRVKAEDVGVYYCMQPLQTPYTFGQGTKLEIK

SEQ ID NO: 681 - protein, 112 aa, Artificial Sequence; identical to SEQ ID NO: 604
  Synthetic construct

SEQ ID NO: 682 - protein, 20 aa, Artificial Sequence
  Synthetic construct
CMQPLQTPYTFGQGTKLEIK

SEQ ID NO: 683 - protein, 112 aa, Artificial Sequence; identical to SEQ ID NO: 609
  Synthetic construct

SEQ ID NO: 684 - protein, 20 aa, Artificial Sequence
  Synthetic construct
CMQPLQTPYTFGQGTKLEIK

SEQ ID NO: 685 - protein, 112 aa, Artificial Sequence; identical to SEQ ID NO: 609
  Synthetic construct

SEQ ID NO: 686 - protein, 112 aa, Artificial Sequence; identical to SEQ ID NO: 609
  Synthetic construct

SEQ ID NO: 687 - protein, 112 aa, Artificial Sequence; identical to SEQ ID NO: 609
  Synthetic construct

SEQ ID NO: 688 - protein, 112 aa, Artificial Sequence; identical to SEQ ID NO: 609
  Synthetic construct

SEQ ID NO: 689 - protein, 112 aa, Artificial Sequence; identical to SEQ ID NO: 604
  Synthetic construct

SEQ ID NO: 690 - protein, 112 aa, Artificial Sequence; identical to SEQ ID NO: 604
  Synthetic construct

SEQ ID NO: 691 - protein, 112 aa, Artificial Sequence; identical to SEQ ID NO: 604
  Synthetic construct

SEQ ID NO: 692 - protein, 112 aa, Artificial Sequence; identical to SEQ ID NO: 604
  Synthetic construct

SEQ ID NO: 693 - protein, 112 aa, Artificial Sequence
  Synthetic construct
DIVMTQTPLSLSVTPGQPASISCKSSQSLLHSDGKTYLYWYLQKPGQSPQLLIYEVSNRFSGVPDGFSGSGSGTDFTLKISRVEAEDVGVYYCMQPLQTPYTFGQGTKLEIK

SEQ ID NO: 694 - protein, 112 aa, Artificial Sequence; identical to SEQ ID NO: 604
  Synthetic construct

SEQ ID NO: 695 - protein, 112 aa, Artificial Sequence; identical to SEQ ID NO: 644
  Synthetic construct

SEQ ID NO: 696 - protein, 112 aa, Artificial Sequence
  Synthetic construct
DIVMTQTPLSLSVTPGQPASISCKSSQSLLHVDGKTYLYWYLQKPGQPPQLLIYEVSNRFSGVPDRFSGSGSGTDFTLKISRVEAEDVGVYYCMQPLQTPYTFGQGTKLEIK

SEQ ID NO: 697 - protein, 112 aa, Artificial Sequence
  Synthetic construct
DIVMTQSPLSLPVTPGEPASISCRSSQSLLHNNGYNYLAWYPQKPGQSPQLLIYLGSNRASGVPDRFSGSGSGTDFTLKISRVKAEDVGVYYCMQPLQTPYTFGQGTKLEIK

SEQ ID NO: 698 - protein, 112 aa, Artificial Sequence; identical to SEQ ID NO: 609
  Synthetic construct

SEQ ID NO: 699 - protein, 112 aa, Artificial Sequence; identical to SEQ ID NO: 610
  Synthetic construct

SEQ ID NO: 700 - protein, 20 aa, Artificial Sequence
  Synthetic construct
CMQPLQTPYTFGQGTKLEIK

SEQ ID NO: 701 - protein, 105 aa, Artificial Sequence; identical to SEQ ID NO: 227
  Synthetic construct

SEQ ID NO: 702 - protein, 106 aa, Artificial Sequence
  Synthetic construct
DIQMTQSPSSLSASVGDRVTITCRASRSISSYLNWYQQKPGKAPNLLIYAASSLQSGVPSRFSGSGSGTDFTLTISSLQPEDFATYYCQQSYSTLTFGQGTKLEIK

SEQ ID NO: 703 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEVK

SEQ ID NO: 704 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 705 - protein, 105 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEI

SEQ ID NO: 706 - protein, 106 aa, Artificial Sequence; identical to SEQ ID NO: 704
  Synthetic construct

SEQ ID NO: 707 - protein, 106 aa, Artificial Sequence
  Synthetic construct
DIQMTQSPSSLSASVGDRVTITCRASQSISSYLNWYQQKPGKAPKLLIYAASSLQSGVPSRYSGSGSGADFTLTISSLQPEDFATYYCQQSYSTLTFGGGTKVEIK

SEQ ID NO: 708 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLRPEDFATYYCQQSYSTLTFGQGTRLEIK

SEQ ID NO: 709 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGPGTKVDIK

SEQ ID NO: 710 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGKDFTLTISSLQPEDFATYYCQQSYSTLTFGGGTKVEIK

SEQ ID NO: 711 - protein, 105 aa, Artificial Sequence
  Synthetic construct
DIQMTQSPSTLSASVGDRVTITCRASQSISSYLNWYQQKPGKAPKLLIYAASSLQSGVPSRFSGSGSGTDFTLTISSLQPEDFATYYCQQSYSTLTFGGGTKEIK

SEQ ID NO: 712 - protein, 106 aa, Artificial Sequence; identical to SEQ ID NO: 704
  Synthetic construct

SEQ ID NO: 713 - protein, 106 aa, Artificial Sequence; identical to SEQ ID NO: 709
  Synthetic construct

SEQ ID NO: 714 - protein, 80 aa, Artificial Sequence
  Synthetic construct
QSISSYLNWYQQKPGKAPKLLIYAASSLQSGVPSRFSGSGSGTDFTLTISSLQPEDFATYYCQQSYSTLTFGGGTKVEIK

SEQ ID NO: 715 - protein, 106 aa, Artificial Sequence
  Synthetic construct
DIQMTQSPSSLSASVGDRVTITCRASQSISSYLNWYQQKPGKAPKLLIYAASSLQSGVPSRFGGSGSGTDFTLTISSLQPEDFATYYCQQSYSTLTFGGGTKVEIK

SEQ ID NO: 716 - protein, 106 aa, Artificial Sequence; identical to SEQ ID NO: 704
  Synthetic construct

SEQ ID NO: 717 - protein, 106 aa, Artificial Sequence
  Synthetic construct
DIQMTQSPSSLSASVGDRVTITCRASQSISNYLNWYQQKPGEAPKLLIYAASSLESGVPSRFSGSGSGADFTLTISSLQPEDFATYYCQQSYSTLTFGGGTKVEIK

SEQ ID NO: 718 - protein, 106 aa, Artificial Sequence
  Synthetic construct
DIQMTQSPSSLSASVGDRVTITCRASQSISNYLNWYQQKPGEAPKLLIYAASSLESGVPSRFSGSGSGTDFTLTISSLQPEDFATYYCQQSYSTLTFGGGTKVEIK

SEQ ID NO: 719 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGQGTKVEIK

SEQ ID NO: 720 - protein, 74 aa, Artificial Sequence
  Synthetic construct
LNWYQQKPGKAPKLLIYAASSLQSGVPSRFSGSGSGTDFTLTISSLQPEDFATYYCQQSYSTLTFGQGTRLEIK

SEQ ID NO: 721 - protein, 106 aa, Artificial Sequence
  Synthetic construct
DILLTQSPSSLSAFVGDTVTITCRASQSSSTYVNWYQQKPGKAPKLLIYAASSLQSGVPSRFSGSGSGTDFTLTISSLQPEDFATYYCQQSYSTLTFGPGTKVDIK

SEQ ID NO: 722 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEEFATYYCQQSYSTLTFGGGTKVEIK

SEQ ID NO: 723 - protein, 106 aa, Artificial Sequence
  Synthetic construct
DIQMTQSPSSLSASVGDRVTITCRASQNISSYLNWYQQKPGKAPKLLIYAASSLQSGVPSRFSGSGSGTDFTLTIISLQPEDFATYYCQQSYSTLTFGGGTKGEIK

SEQ ID NO: 724 - protein, 106 aa, Artificial Sequence
  Synthetic construct
DIQMTQSPSSLSASVGDRVTITCRASRSISSYLNWYQQKPGKAPKLLIYAASSLQSGVPSRFSGSGSGTDFTLTISSLQPEDFATYYCQQSYSTLTFGGGTKVEIK

SEQ ID NO: 725 - protein, 106 aa, Artificial Sequence
  Synthetic construct
DIQMTQSPSSVSASVGDRVTITCRASQGISSWLAWYQQKPGKAPKLLIYAASSLQSGVPSRFSGSGSGTDFTLTISSLQPEDFATYYCQQSYSTLTFGQGTRLEIK

SEQ ID NO: 726 - protein, 106 aa, Artificial Sequence
  Synthetic construct
AIRITQSPSSLSASTGDRVTITCRASQGISNYLAWFQQKPGKAPKLLIYAASSLQSGAPSRFSGSGSGTDFTLTISSLQPEDFATYYCQQSYSTLTFGGGTKVEIK

SEQ ID NO: 727 - protein, 106 aa, Artificial Sequence
  Synthetic construct
DIQMTQSPSSLSATVGDRVTITCRASQSISNYLNWYQQKPGEAPKPLIYAASSLESGVPSRFSGSGSGTDFTLTISSLQPEDFATYYCQQSYSTLTFGGGTKVEIK

SEQ ID NO: 728 - protein, 106 aa, Artificial Sequence
  Synthetic construct
DIQMTQSPSSMSASVGDRVTITCRASQGISSWLAWYQQRPGKAPKLLIYDASRLQSGVPSRFSGSRSGTDFTLTISSLQPEDFATYYCQQSYSTLTFGGGTKVEIK

SEQ ID NO: 729 - protein, 106 aa, Artificial Sequence; identical to SEQ ID NO: 719
  Synthetic construct

SEQ ID NO: 730 - protein, 106 aa, Artificial Sequence; identical to SEQ ID NO: 704
  Synthetic construct

SEQ ID NO: 731 - protein, 104 aa, Artificial Sequence
  Synthetic construct
QMPQSPSSLSASVGDRVTITCRASQSISSYLNWYQQKPGKAPKLLIYAASSLQSGVPSRFSGSGSGTDFTLTISSLQPEDFGTYYCQQSYSTLTFGGGTKVEIK

SEQ ID NO: 732 - protein, 106 aa, Artificial Sequence; identical to SEQ ID NO: 704
  Synthetic construct

SEQ ID NO: 733 - protein, 106 aa, Artificial Sequence; identical to SEQ ID NO: 704
  Synthetic construct

SEQ ID NO: 734 - protein, 106 aa, Artificial Sequence
  Synthetic construct
DIQMTQSPSSLSASVGDRVTITCRASQSISNYLNWYQQKPGVAPKLLIYAASSLESGVPSRFSGSGSGTDFTLTISSLQPEDFATYYCQQSYSTLTFGGGTKVEIK

SEQ ID NO: 735 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGQGTRLEIK

SEQ ID NO: 736 - protein, 106 aa, Artificial Sequence
  Synthetic construct
DIQLTQSPSSLAASVGDRVTITCRASQPIVNYLHWYQQKSGKAPQLLIYSASTLHSGVPSRFIGSGSGADFTLTINNLQPDDFATYYCQQSYSTLTFGQGTKVEIK

SEQ ID NO: 737 - protein, 106 aa, Artificial Sequence
  Synthetic construct
DIQMTQSPSSLSASVGDKVTITCRASQSISTYLNWYQQKPGKAPKLLIYAASSLQTGVPSRFSGSGSGTDFTLTISSLQPEDFATFYCQQSYSTLTFGGGTKVEIK

SEQ ID NO: 738 - protein, 105 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDSATYYCQQSYSTLTFGGGTKVEI

SEQ ID NO: 739 - protein, 106 aa, Artificial Sequence; identical to SEQ ID NO: 704
  Synthetic construct

SEQ ID NO: 740 - protein, 106 aa, Artificial Sequence; identical to SEQ ID NO: 704
  Synthetic construct

SEQ ID NO: 741 - protein, 106 aa, Artificial Sequence; identical to SEQ ID NO: 709
  Synthetic construct

SEQ ID NO: 742 - protein, 106 aa, Artificial Sequence; identical to SEQ ID NO: 709
  Synthetic construct

SEQ ID NO: 743 - protein, 106 aa, Artificial Sequence
  Synthetic construct
DIQMTQSPSSLSASVGDRVTITCRASQSIRSYLNWYQQKPGKAPKLLIYAASSLQSGVPSRFSGSGSGTDFTPTISSLHPEDFATYYCQQSYSTLTFGGGTKVEIK

SEQ ID NO: 744 - protein, 106 aa, Artificial Sequence; identical to SEQ ID NO: 704
  Synthetic construct

SEQ ID NO: 745 - protein, 19 aa, Artificial Sequence
  Synthetic construct
CQQSYSTLTFGGGTKVEIK

SEQ ID NO: 746 - protein, 80 aa, Artificial Sequence
  Synthetic construct
QGISSYLAWYQQKPGKAPKLLIYAASTLQSGVPSSFSGSGSGTDFTLTISSLQPEDFATYYCQQSYSTLTFGGGTKVEIK

SEQ ID NO: 747 - protein, 106 aa, Artificial Sequence; identical to SEQ ID NO: 735
  Synthetic construct

SEQ ID NO: 748 - protein, 106 aa, Artificial Sequence; identical to SEQ ID NO: 704
  Synthetic construct

SEQ ID NO: 749 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTIRSLQPEDFATYYCQQSYSTLTFGGGTKVEIK

SEQ ID NO: 750 - protein, 106 aa, Artificial Sequence; identical to SEQ ID NO: 719
  Synthetic construct

SEQ ID NO: 751 - protein, 106 aa, Artificial Sequence
  Synthetic construct
DIQMTQSPSSLSASVGDRVTITCRASQSISSYLKWYQQKPGKAPKLLIYAASSLQSGVPTRFSGSGSGTDFTLTISSLQPEDFATYYCQQSYSTLTFGGGTKVEIK

SEQ ID NO: 752 - protein, 106 aa, Artificial Sequence
  Synthetic construct
DIQMTQSPSSVSASVGDRVTITCRASQGISSWLAWYQQKPGKAPKLLIYAASSLQSGVPSRFSGSGSGTDFTLTISSLQPEDFATYYCQQSYSTLTFGPGTKVEIK

SEQ ID NO: 753 - protein, 106 aa, Artificial Sequence; identical to SEQ ID NO: 704
  Synthetic construct

SEQ ID NO: 754 - protein, 106 aa, Artificial Sequence
  Synthetic construct
DIQMTQSPSSLSASVGDRVTFTCRASQSISSYLNWYQQKPGKAPKLLIYAASSLQSGVPSRFSGSGSGTDFTLTISSLQPEDFATYYCQQSYSTLTFGPGTKVDIK

SEQ ID NO: 755 - protein, 106 aa, Artificial Sequence
  Synthetic construct
DIQMTQSPSSLSASVGDRVTITCRASQTINNYLNWYQQKPGKAPKLLIYAASSLQSGVPSRFSGSGSGTDFTLTISTLQPDDFATYYCQQSYSTLTFGGGTKVEIK

SEQ ID NO: 756 - protein, 106 aa, Artificial Sequence
  Synthetic construct
DIQMTQSPSSLSASVGDRVTITCRASQSISNYLNWYQQKPGKAPKLLIYAASSLQSGVPSRFSGSGSGTDFTLTISSLQPEDFATYYCQQSYSTLTFGPGTKVDIK

SEQ ID NO: 757 - protein, 106 aa, Artificial Sequence
  Synthetic construct
DIQMTQSPSTLSASVGDRVTITCRASQSISSYLNWYQQKPGKAPKLLIYAASSLQSGVPSRFSGSGSGTDFTLTISSLQPEDFATYYCQQSYSTLTFGQGTKVEIK

SEQ ID NO: 758 - protein, 106 aa, Artificial Sequence; identical to SEQ ID NO: 735
  Synthetic construct

SEQ ID NO: 759 - protein, 106 aa, Artificial Sequence; identical to SEQ ID NO: 709
  Synthetic construct

SEQ ID NO: 760 - protein, 106 aa, Artificial Sequence; identical to SEQ ID NO: 718
  Synthetic construct

SEQ ID NO: 761 - protein, 106 aa, Artificial Sequence; identical to SEQ ID NO: 735
  Synthetic construct

SEQ ID NO: 762 - protein, 106 aa, Artificial Sequence; identical to SEQ ID NO: 704
  Synthetic construct

SEQ ID NO: 763 - protein, 106 aa, Artificial Sequence; identical to SEQ ID NO: 704
  Synthetic construct

SEQ ID NO: 764 - protein, 106 aa, Artificial Sequence; identical to SEQ ID NO: 704
  Synthetic construct

SEQ ID NO: 765 - protein, 106 aa, Artificial Sequence; identical to SEQ ID NO: 735
  Synthetic construct

SEQ ID NO: 766 - protein, 106 aa, Artificial Sequence
  Synthetic construct
DIQMTQSPSSMSASVGDRVSITCRASQGISSWLAWYQQRPGKAPKLLIYDASRLQSGVPSRFSGSGSGTAFTLTISSLQPEDFATYYCQQSYSTLTFGPGTKVDIK

SEQ ID NO: 767 - protein, 106 aa, Artificial Sequence
  Synthetic construct
DIQMTQSPSSLSASVGDRVTITCRASQSISNYLSWYQQKPGEAPKLLIYAASSLESGVPSRFSGSGSGTDFTLTISSLQPEDFATYYCQQSYSTLTFGGGTKVEIK

SEQ ID NO: 768 - protein, 106 aa, Artificial Sequence; identical to SEQ ID NO: 704
  Synthetic construct

SEQ ID NO: 769 - protein, 106 aa, Artificial Sequence; identical to SEQ ID NO: 704
  Synthetic construct

SEQ ID NO: 770 - protein, 106 aa, Artificial Sequence
  Synthetic construct
DIQMTQSPSSLSASVGDRVTITCRASQSISSYLNWYQQKPGKAPKLLIYAASSLQSGVPSKFSGSGSGTDFTLTISSLQPEDFATYYCQQSYSTLTFGGGTKVEIK

SEQ ID NO: 771 - protein, 106 aa, Artificial Sequence
  Synthetic construct
DIQMTQSPSSLSVSVGDRVTITCRASQSISSYLNWYQQKPGKAPKLLIYAASSLQSGVPSRFSGSGSGTDFTLTISSLQPEDFATYYCQQSYSTLTFGQGTRLEIK

SEQ ID NO: 772 - protein, 106 aa, Artificial Sequence; identical to SEQ ID NO: 704
  Synthetic construct

SEQ ID NO: 773 - protein, 106 aa, Artificial Sequence; identical to SEQ ID NO: 704
  Synthetic construct

SEQ ID NO: 774 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVVIK

SEQ ID NO: 775 - protein, 106 aa, Artificial Sequence; identical to SEQ ID NO: 709
  Synthetic construct

SEQ ID NO: 776 - protein, 106 aa, Artificial Sequence; identical to SEQ ID NO: 704
  Synthetic construct

SEQ ID NO: 777 - protein, 106 aa, Artificial Sequence
  Synthetic construct
DIQMTQSPSSLSASVGDRVTITRRASQSISSYLNWYQQKPGKAPKLLIYAASSLQSGVPSRFSGSGSGTDFTLTISSLQPEDFATYYCQQSYSTLTFGGGTKVEIK

SEQ ID NO: 778 - protein, 106 aa, Artificial Sequence
  Synthetic construct
DIQMTQSPSSLSASVGDRVTITCQASQDISNYLNWYQQKPGEAPKLLIYAASSLESGVPSRFSGSGSGTDFTRTISSLQPEDFATYYCQQSYSTLTFGGGTKVEIK

SEQ ID NO: 779 - protein, 106 aa, Artificial Sequence; identical to SEQ ID NO: 709
  Synthetic construct

SEQ ID NO: 780 - protein, 80 aa, Artificial Sequence; identical to SEQ ID NO: 714
  Synthetic construct

SEQ ID NO: 781 - protein, 106 aa, Artificial Sequence
  Synthetic construct
DIQMTQSPSSLSASVGDRVTITCRACQSISTYLNWYQQKPGKAPKLLIYAASSLQTGVPSRFSGSGSGTDFTLTISSLQPEDFATFYCQQSYSTLTFGGGTKVETK

SEQ ID NO: 782 - protein, 106 aa, Artificial Sequence; identical to SEQ ID NO: 709
  Synthetic construct

SEQ ID NO: 783 - protein, 106 aa, Artificial Sequence
  Synthetic construct
DIQMTQSPSSLSASAGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 784 - protein, 106 aa, Artificial Sequence
  Synthetic construct
DIQMTQSPSSLSASVGDRVTITCRASQSISSYLNWYQQKPGKAPKLLIYAASSLQRGVPSRFSGSGSGTDFTLTNSSLQPEDFATYYCQQSYSTLTFGGGTKVEIK

SEQ ID NO: 785 - protein, 106 aa, Artificial Sequence; identical to SEQ ID NO: 704
  Synthetic construct

SEQ ID NO: 786 - protein, 106 aa, Artificial Sequence
  Synthetic construct
DIQMTQSPSSLSASVGDRVTITCRASQSISSYLNWYQQKPGKAPKLLIYAASSLQSGVPSGFSGSGSGTDFTLTISSLQPEDFATYYCQQSYSTLTFGGGTKVEIK

SEQ ID NO: 787 - protein, 106 aa, Artificial Sequence
  Synthetic construct
DIQMAQSPSSLSASVGDRVTITCRASQSISNYLNWYQQKPGEAPKLLIYAASSLESGVPSRFSGSGSGTDFTLTISSLQPEDFATYYCQQSYSTLTFGGGTKVEIK

SEQ ID NO: 788 - protein, 106 aa, Artificial Sequence; identical to SEQ ID NO: 704
  Synthetic construct

SEQ ID NO: 789 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEGFATYYCQQSYSTLTFGPGTKVDIK

SEQ ID NO: 790 - protein, 106 aa, Artificial Sequence
  Synthetic construct
DIQMTQSPSSLSASVGDRVTITCRASQSISSYLNWYQQKPGKAPKLLVYAASSLQSGVPSRFSGSGSGTDFTLTISSLQPEDFATYYCQQSYSTLTFGGGTKVEIK

SEQ ID NO: 791 - protein, 105 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGPGTKVDI

SEQ ID NO: 792 - protein, 106 aa, Artificial Sequence; identical to SEQ ID NO: 718
  Synthetic construct

SEQ ID NO: 793 - protein, 57 aa, Artificial Sequence
  Synthetic construct
AASSLQSGVPSRFSGSGSGTDFTLTISSLQPEDFATYYCQQSYSTLTFGQGTRLEFK

SEQ ID NO: 794 - protein, 106 aa, Artificial Sequence
  Synthetic construct
DIQMTQSPSSLSASVGDRVTITCRASQSISSYLNWYQQKPGKTPKLLIYAASSLQSGVPSRFSGSGSGTDFTLTISSLQPEDFATYYCQQSYSTLTFGGGTKVEIK

SEQ ID NO: 795 - protein, 106 aa, Artificial Sequence; identical to SEQ ID NO: 704
  Synthetic construct

SEQ ID NO: 796 - protein, 106 aa, Artificial Sequence; identical to SEQ ID NO: 704
  Synthetic construct

SEQ ID NO: 797 - protein, 106 aa, Artificial Sequence; identical to SEQ ID NO: 735
  Synthetic construct

SEQ ID NO: 798 - protein, 106 aa, Artificial Sequence; identical to SEQ ID NO: 704
  Synthetic construct

SEQ ID NO: 799 - protein, 106 aa, Artificial Sequence
  Synthetic construct
DIQMTQFPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 800 - protein, 106 aa, Artificial Sequence; identical to SEQ ID NO: 709
  Synthetic construct

SEQ ID NO: 801 - protein, 106 aa, Artificial Sequence; identical to SEQ ID NO: 704
  Synthetic construct

SEQ ID NO: 802 - protein, 106 aa, Artificial Sequence
  Synthetic construct
DIQMTQSPSSLSASVGDRVTITCRASQNINTWLAWYQQKAGKAPKLLIYDVSSLESGVPSRFSGSGSGTDFTLTISSLQPEDFATYYCQQSYSTLTFGGGTKVEIK

SEQ ID NO: 803 - protein, 106 aa, Artificial Sequence; identical to SEQ ID NO: 704
  Synthetic construct

SEQ ID NO: 804 - protein, 106 aa, Artificial Sequence
  Synthetic construct
DIQMTQSPSSLSASVGDRVTITCRASQSISRYLNWYQQKPGKAPKLLIYAASSLQSGVPSRFSGSGSGTDFTLTISSLQPEDFATYYCQQSYSTLTFGQGTKLEIK

SEQ ID NO: 805 - protein, 106 aa, Artificial Sequence; identical to SEQ ID NO: 704
  Synthetic construct

SEQ ID NO: 806 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGQGTKLEIK

SEQ ID NO: 807 - protein, 106 aa, Artificial Sequence
  Synthetic construct
DIQITQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 808 - protein, 106 aa, Artificial Sequence
  Synthetic construct
DIQMTQSPSSLSASVGVRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 809 - protein, 106 aa, Artificial Sequence
  Synthetic construct
DIQMTQSPSSLSASVGDGVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 810 - protein, 112 aa, Artificial Sequence
  Synthetic construct
DIVMTQSPDSLAVFLGERATINCKSSQSVLYSSNNKNYLAWYQQKPGQPPKLLIYWASTRESGVPDRFSGSGSGTDFTLTISSLQAEDFATYYCQQSYSTLTFGQGTRLEIK

SEQ ID NO: 811 - protein, 106 aa, Artificial Sequence
  Synthetic construct
DIQMTQSPSSLSASVGDRVTITCRASQSISSYLNWYQQKLGKAPKLLIYAASSLQSGVPSRFSGSGSGTDFTLTISSLQPEDFATYYCQQSYSTLTFGQGTKVEIK

SEQ ID NO: 812 - protein, 106 aa, Artificial Sequence
  Synthetic construct
DIQMTQSPSSLSASVGDRVTITCRASQGTSNYLACYQQKPGKVPKFLIYAASTLQSGVPSRLSGSGSGTDFTLTISSLQPEDFATYYCQQSYSTLTFGQGTRLEMK

SEQ ID NO: 813 - protein, 57 aa, Artificial Sequence
  Synthetic construct
AASSLQSGVPSRFSGSGSGTDFTLTISSLQPEDFATYYCQQSYSTLTFGQGTKVEIK

SEQ ID NO: 814 - protein, 106 aa, Artificial Sequence
  Synthetic construct
DIQMTQSPSYLSASVGDRVTITCRASQSISSYLNWYQQKPGKAPKLLIYVASSLLSGVPSRFSGSGSGTDFTLTISSLQPEDFATYYCQQSYSTLTFGGGTKVEIK

SEQ ID NO: 815 - protein, 106 aa, Artificial Sequence; identical to SEQ ID NO: 709
  Synthetic construct

SEQ ID NO: 816 - protein, 106 aa, Artificial Sequence; identical to SEQ ID NO: 709
  Synthetic construct

SEQ ID NO: 817 - protein, 106 aa, Artificial Sequence; identical to SEQ ID NO: 709
  Synthetic construct

SEQ ID NO: 818 - protein, 106 aa, Artificial Sequence; identical to SEQ ID NO: 709
  Synthetic construct

SEQ ID NO: 819 - protein, 106 aa, Artificial Sequence; identical to SEQ ID NO: 718
  Synthetic construct

SEQ ID NO: 820 - protein, 57 aa, Artificial Sequence
  Synthetic construct
AASSLQSGVPSRFSGSGSGTDFTLTISSLQPEDFATYYCQQSYSTLTFGQGTRLEIK

SEQ ID NO: 821 - protein, 80 aa, Artificial Sequence
  Synthetic construct
QSINTLLAWFQQKPGKAPKSLIYGASSLQSGVPSRFSGSGSGTDFTLTISSLQPEDFATYYCQQSYSTLTFGPGTKVDIK

SEQ ID NO: 822 - protein, 80 aa, Artificial Sequence; identical to SEQ ID NO: 714
  Synthetic construct

SEQ ID NO: 823 - protein, 105 aa, Artificial Sequence
  Synthetic construct
DIQMTQSPSSLSASLGDRVTITCRASQSISRYLNWYQQKPGKAPKLPIYAASSLQSGVPSRFSGSGSGTDFTLTISSLQPEDFATYYCQQSYSTLTFGGGTKVEI

SEQ ID NO: 824 - protein, 106 aa, Artificial Sequence; identical to SEQ ID NO: 704
  Synthetic construct

SEQ ID NO: 825 - protein, 106 aa, Artificial Sequence; identical to SEQ ID NO: 704
  Synthetic construct

SEQ ID NO: 826 - protein, 106 aa, Artificial Sequence; identical to SEQ ID NO: 709
  Synthetic construct

SEQ ID NO: 827 - protein, 106 aa, Artificial Sequence
  Synthetic construct
DIQMTQSPSSLSASVGDRVTITCRASQSISSYLNWYQQKPGKAPKLLIYAASSLQIGVPSRFSGSGSGTDFTLTISSLQPEDFSTYYCQQSYSTLTFGGGTKVEIK

SEQ ID NO: 828 - protein, 106 aa, Artificial Sequence
  Synthetic construct
DIQMTQSPSSLSASVGDRVTITCRASQSISSYLNWYQLKPGKAPKLLIYAASSLQSGVPSRFSGSGSGTDFTLTISSLQPEDFATYYCQQSYSTLTFGGGTKVEIK

SEQ ID NO: 829 - protein, 106 aa, Artificial Sequence; identical to SEQ ID NO: 704
  Synthetic construct

SEQ ID NO: 830 - protein, 106 aa, Artificial Sequence; identical to SEQ ID NO: 704
  Synthetic construct

SEQ ID NO: 831 - protein, 106 aa, Artificial Sequence
  Synthetic construct
DIQMTQSPSSLSASVGDRVTITCRASQSISSYLNWYQQEPGKAPKLLIYAASSLQSGVPSRFSGSGSGTDFTLTISSLQPEDFATYYCQQSYSTLTFGGGTKVEIK

SEQ ID NO: 832 - protein, 106 aa, Artificial Sequence
  Synthetic construct
DIQMTQSPSSLSASVGDRVTITCRASQNISSYLNWYQQKPGKAPNVLIYAASSLQSGVPSRFSGSGSGTDFTLTISSLQPEDFATYYCQQSYSTLTFGGGTKVEIK

SEQ ID NO: 833 - protein, 106 aa, Artificial Sequence; identical to SEQ ID NO: 704
  Synthetic construct

SEQ ID NO: 834 - protein, 106 aa, Artificial Sequence; identical to SEQ ID NO: 704
  Synthetic construct

SEQ ID NO: 835 - protein, 106 aa, Artificial Sequence; identical to SEQ ID NO: 735
  Synthetic construct

SEQ ID NO: 836 - protein, 74 aa, Artificial Sequence
  Synthetic construct
LNWYQQKPGEAPKLLIYAASSLESGVPSRFSGSGSGTDFTLTISSLQPEDFATYYCQQSYSTLTFGGGTKVEIK

SEQ ID NO: 837 - protein, 106 aa, Artificial Sequence; identical to SEQ ID NO: 709
  Synthetic construct

SEQ ID NO: 838 - protein, 53 aa, Artificial Sequence
  Synthetic construct
LQSGVPSRFGGSGSGTDFTLTISSLQPEDFATYYCQQSYSTLTFGGGTKVEIK

SEQ ID NO: 839 - protein, 106 aa, Artificial Sequence; identical to SEQ ID NO: 704
  Synthetic construct

SEQ ID NO: 840 - protein, 106 aa, Artificial Sequence; identical to SEQ ID NO: 719
  Synthetic construct

SEQ ID NO: 841 - protein, 80 aa, Artificial Sequence
  Synthetic construct
QSISSYLNWYQQKPGKAPKLLIYAASSLQSGVPSRFSGSGSGTDFTLTISSLQPEDFATYYCQQSYSTLTFGPGTKVDIK

SEQ ID NO: 842 - protein, 106 aa, Artificial Sequence; identical to SEQ ID NO: 704
  Synthetic construct

SEQ ID NO: 843 - protein, 106 aa, Artificial Sequence; identical to SEQ ID NO: 704
  Synthetic construct

SEQ ID NO: 844 - protein, 106 aa, Artificial Sequence
  Synthetic construct
DIQMTQSPSSLSASVGDRVTITCRASQSISSYLNWYQQKRGKAPKLLIYAASSLQSGVPSRFSGSGSGTDFTLTISSLQPEDFATYHCQQSYSTLTFGGGTKVEIK

SEQ ID NO: 845 - protein, 106 aa, Artificial Sequence; identical to SEQ ID NO: 704
  Synthetic construct

SEQ ID NO: 846 - protein, 106 aa, Artificial Sequence; identical to SEQ ID NO: 735
  Synthetic construct

SEQ ID NO: 847 - protein, 106 aa, Artificial Sequence; identical to SEQ ID NO: 704
  Synthetic construct

SEQ ID NO: 848 - protein, 106 aa, Artificial Sequence; identical to SEQ ID NO: 719
  Synthetic construct

SEQ ID NO: 849 - protein, 106 aa, Artificial Sequence
  Synthetic construct
DIQMTQSPSSLSASVGDRVTITCRASQSISSYLNWYQQKPGKAPKLVIYAASSLQSGVPSRFSGSGSGTDFTLTISSLQPEDFATYYCQQSYSTLTFGGGTKVEIK

SEQ ID NO: 850 - protein, 106 aa, Artificial Sequence; identical to SEQ ID NO: 704
  Synthetic construct

SEQ ID NO: 851 - protein, 106 aa, Artificial Sequence; identical to SEQ ID NO: 735
  Synthetic construct

SEQ ID NO: 852 - protein, 106 aa, Artificial Sequence
  Synthetic construct
DIQMTQSPSSLSASVGDRVTITCRASQSISSHLNWYQQKPGKAPKLLIYATSSLQSGVPSRFSGSGSGTDFTLTISSLQPEDFATYYCQQSYSTLTFGGGTKVEIK

SEQ ID NO: 853 - protein, 106 aa, Artificial Sequence; identical to SEQ ID NO: 718
  Synthetic construct

SEQ ID NO: 854 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGPGTKEDIK

SEQ ID NO: 855 - protein, 80 aa, Artificial Sequence; identical to SEQ ID NO: 841
  Synthetic construct

SEQ ID NO: 856 - protein, 106 aa, Artificial Sequence
  Synthetic construct
DIQMTQSPSTLSASVGDRVTITCRASQGIVKWLAWYQQKPGRAPKLLIYKASSLESGVPSRFSGSGSGTEFTLTISSLQPEDFATYYCQQSYSTLTFGGGTKVEIK

SEQ ID NO: 857 - protein, 106 aa, Artificial Sequence; identical to SEQ ID NO: 709
  Synthetic construct

SEQ ID NO: 858 - protein, 106 aa, Artificial Sequence; identical to SEQ ID NO: 704
  Synthetic construct

SEQ ID NO: 859 - protein, 106 aa, Artificial Sequence; identical to SEQ ID NO: 704
  Synthetic construct

SEQ ID NO: 860 - protein, 106 aa, Artificial Sequence
  Synthetic construct
DIQMTQSPSSLSASVGDRVTITCRASQSISRYLNWYQQKPGKAPKLLIYAASSLQSGVPSRFSGSGSGTDFTLTISSLQPEDFATYYCQQSYSTLTFGGGTKVEIK

SEQ ID NO: 861 - protein, 106 aa, Artificial Sequence
  Synthetic construct
DIQMTQSPSSLSASVGDRVTITCRASQSISNYLNRYQQKPGEAPKLLIYAASSLESGVPSRFSGSGSGTDFTLTISSLQPEDFATYYCQQSYSTLTFGGGTKVEIK

SEQ ID NO: 862 - protein, 106 aa, Artificial Sequence; identical to SEQ ID NO: 709
  Synthetic construct

SEQ ID NO: 863 - protein, 80 aa, Artificial Sequence; identical to SEQ ID NO: 714
  Synthetic construct

SEQ ID NO: 864 - protein, 106 aa, Artificial Sequence
  Synthetic construct
DIQVTQSPSSLSASVGDRVTITCRASQSISSDLNWYQQKPGKAPKLLIYAASSLQSGVPSRFSGSGSGTDFTLTISSLQPEDFATYYCQQSYSTLTFGGGTKVEIK

SEQ ID NO: 865 - protein, 106 aa, Artificial Sequence
  Synthetic construct
DIQMTQSPSTLSASIGDRVTITCRASQSVSSWLAWYQQKPGKAPNLLIYKASDLETGVPSRFSGSGSRTEFTLTISSLQPEDFATYYCQQSYSTLTFGGGTKVEIK

SEQ ID NO: 866 - protein, 106 aa, Artificial Sequence; identical to SEQ ID NO: 704
  Synthetic construct

SEQ ID NO: 867 - protein, 80 aa, Artificial Sequence
  Synthetic construct
QGIRNDLGWYQQKPGKAPKLLIYAASSLQSGVPSRFSGSGSGTDFTLTISSLQPEDFATYYCQQSYSTLTFGGGTKVEIK

SEQ ID NO: 868 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFPLTISSLQPEDFATYYCQQSYSTLTFGGGTKVEIK

SEQ ID NO: 869 - protein, 106 aa, Artificial Sequence; identical to SEQ ID NO: 704
  Synthetic construct

SEQ ID NO: 870 - protein, 106 aa, Artificial Sequence
  Synthetic construct
DIQMTQSPSSLSASVGDRVTITCRASQSISDYLNWYQQKPGKAPKLLIFAASNLESGTPSRFSGSGSGTDFTLTISSLQPEDFATYYCQQSYSTLTFGGRTKVEIK

SEQ ID NO: 871 - protein, 106 aa, Artificial Sequence
  Synthetic construct
DIRMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 872 - protein, 106 aa, Artificial Sequence; identical to SEQ ID NO: 704
  Synthetic construct

SEQ ID NO: 873 - protein, 106 aa, Artificial Sequence; identical to SEQ ID NO: 718
  Synthetic construct

SEQ ID NO: 874 - protein, 106 aa, Artificial Sequence
  Synthetic construct
DIQMTQSPSSLSASVGDRVTITCRAGQSISNYLNWYQQKPGEAPKLLIYAASSLESGVPSRFSGSGSGTDFTLTISSLQPEDFATYYCQQSYSTLTFGGGTKVESK

SEQ ID NO: 875 - protein, 106 aa, Artificial Sequence; identical to SEQ ID NO: 704
  Synthetic construct

SEQ ID NO: 876 - protein, 74 aa, Artificial Sequence; identical to SEQ ID NO: 720
  Synthetic construct

SEQ ID NO: 877 - protein, 106 aa, Artificial Sequence; identical to SEQ ID NO: 704
  Synthetic construct

SEQ ID NO: 878 - protein, 80 aa, Artificial Sequence
  Synthetic construct
QSISSYLNWYQQKPGKAPKLLIYAASSLQSGVPSRFSGSGSGTDFTLTISSLQPEDLATYYCQQSYSTLTFGQGTRLEIK

SEQ ID NO: 879 - protein, 106 aa, Artificial Sequence
  Synthetic construct
DIQMTQSPSSLSASVGDRVTITCRASQRISSYLNWYQQKPGKAPKLLIYAASSLQSGVPSRFSGSGSGTDFTLTISSLQPEDFATYYCQQSYSTLTFGPGTKVDIK

SEQ ID NO: 880 - protein, 19 aa, Artificial Sequence
  Synthetic construct
CQQSYSTLTFGGGTKVEIK

SEQ ID NO: 881 - protein, 80 aa, Artificial Sequence; identical to SEQ ID NO: 841
  Synthetic construct

SEQ ID NO: 882 - protein, 106 aa, Artificial Sequence; identical to SEQ ID NO: 718
  Synthetic construct

SEQ ID NO: 883 - protein, 80 aa, Artificial Sequence
  Synthetic construct
QGISYYLAWYRQKPGRAPNLLIYGASTLQSGVPSRFNGSGSGTDFTLTISSLQPEDFATYYCQQSYSTLTFGGGTKVEIK

SEQ ID NO: 884 - protein, 19 aa, Artificial Sequence
  Synthetic construct
CQQSYSTLTFGGGTKVEIK

SEQ ID NO: 885 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISCLQPEDFATYYCQQSYSTLTFGQGTRLEIK

SEQ ID NO: 886 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGQGTRLEMK

SEQ ID NO: 887 - protein, 106 aa, Artificial Sequence; identical to SEQ ID NO: 704
  Synthetic construct

SEQ ID NO: 888 - protein, 19 aa, Artificial Sequence
  Synthetic construct
CQQSYSTLTFGGGTKVEIK

SEQ ID NO: 889 - protein, 19 aa, Artificial Sequence
  Synthetic construct
CQQSYSTLTFGGGTKVEIK

SEQ ID NO: 890 - protein, 106 aa, Artificial Sequence; identical to SEQ ID NO: 704
  Synthetic construct

SEQ ID NO: 891 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTINSLQPEDFATYYCQQSYSTLTFGGGTKVEIK

SEQ ID NO: 892 - protein, 106 aa, Artificial Sequence; identical to SEQ ID NO: 704
  Synthetic construct

SEQ ID NO: 893 - protein, 106 aa, Artificial Sequence; identical to SEQ ID NO: 704
  Synthetic construct

SEQ ID NO: 894 - protein, 57 aa, Artificial Sequence
  Synthetic construct
AASSLQSGVPSRFSGSGSGTDFTLTISSLQPEDFATYYCQQSYSTLTFGGGTKVEIK

SEQ ID NO: 895 - protein, 106 aa, Artificial Sequence; identical to SEQ ID NO: 704
  Synthetic construct

SEQ ID NO: 896 - protein, 106 aa, Artificial Sequence; identical to SEQ ID NO: 704
  Synthetic construct

SEQ ID NO: 897 - protein, 106 aa, Artificial Sequence; identical to SEQ ID NO: 704
  Synthetic construct

SEQ ID NO: 898 - protein, 106 aa, Artificial Sequence; identical to SEQ ID NO: 718
  Synthetic construct

SEQ ID NO: 899 - protein, 106 aa, Artificial Sequence
  Synthetic construct
DFQMTQSPSSLSASVGDRVTITCRASQSISSYLNWYQRKPGKAPKLLIYAASSLQSGVPSRFSGSGSGTDFTLTISSLQPEDFATYYCQQSYSTLTFVPGTKVDIK

SEQ ID NO: 900 - protein, 106 aa, Artificial Sequence; identical to SEQ ID NO: 735
  Synthetic construct

SEQ ID NO: 901 - protein, 57 aa, Artificial Sequence; identical to SEQ ID NO: 894
  Synthetic construct

SEQ ID NO: 902 - protein, 106 aa, Artificial Sequence; identical to SEQ ID NO: 718
  Synthetic construct

SEQ ID NO: 903 - protein, 106 aa, Artificial Sequence
  Synthetic construct
DIQMTQSPSSLSASVGDRVAITCRASQSISSYLNWYQQKPGKAPKLLIYAASSLQSGVPSRFSGSGSGTDFTLTISSLQPEDFATYYCQQSYSTLTFGQGTRLEIK

SEQ ID NO: 904 - protein, 106 aa, Artificial Sequence; identical to SEQ ID NO: 719
  Synthetic construct

SEQ ID NO: 905 - protein, 106 aa, Artificial Sequence
  Synthetic construct
DIQMTQSPSSLSASVGDRVTITCRASQSISNYLNWYQQKPGEAPKLLIYAASSLESGVPSRFSGSGSGTDFTLTTSSLQPEDFATYYCQQSYSTLTFGGGTKVEIK

SEQ ID NO: 906 - protein, 106 aa, Artificial Sequence
  Synthetic construct
DIQMTQSPSSLSASVGDRVTITCRASQSISSYLNWYQQKPGKALKLLIYAASSLQSGVPSRFSGSGSGTDFTLTISSLQPEDFATYYCQQSYSTLTFGGGSKVEIK

SEQ ID NO: 907 - protein, 106 aa, Artificial Sequence; identical to SEQ ID NO: 704
  Synthetic construct

SEQ ID NO: 908 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGPRTKVDIK

SEQ ID NO: 909 - protein, 106 aa, Artificial Sequence; identical to SEQ ID NO: 704
  Synthetic construct

SEQ ID NO: 910 - protein, 106 aa, Artificial Sequence; identical to SEQ ID NO: 709
  Synthetic construct

SEQ ID NO: 911 - protein, 106 aa, Artificial Sequence; identical to SEQ ID NO: 735
  Synthetic construct

SEQ ID NO: 912 - protein, 106 aa, Artificial Sequence; identical to SEQ ID NO: 704
  Synthetic construct

SEQ ID NO: 913 - protein, 106 aa, Artificial Sequence; identical to SEQ ID NO: 704
  Synthetic construct

SEQ ID NO: 914 - protein, 106 aa, Artificial Sequence; identical to SEQ ID NO: 704
  Synthetic construct

SEQ ID NO: 915 - protein, 80 aa, Artificial Sequence; identical to SEQ ID NO: 714
  Synthetic construct

SEQ ID NO: 916 - protein, 106 aa, Artificial Sequence; identical to SEQ ID NO: 704
  Synthetic construct

SEQ ID NO: 917 - protein, 106 aa, Artificial Sequence; identical to SEQ ID NO: 719
  Synthetic construct

SEQ ID NO: 918 - protein, 106 aa, Artificial Sequence; identical to SEQ ID NO: 860
  Synthetic construct

SEQ ID NO: 919 - protein, 106 aa, Artificial Sequence
  Synthetic construct
DIQMTQSPSSLSASVGDRVTITCRATQSISSYLNWYQQKPGKAPKLLIYAASSLQSGVPSRFSGSGSGTEFTLTISSLQPEDFATYYCQQSYSTLTFGQGTKVEIK

SEQ ID NO: 920 - protein, 106 aa, Artificial Sequence
  Synthetic construct
DIQMTQSPSSLSASVGDRVTITCRASQSISSYLNWYQQKPGKAPKLPIYAASSLQSGVPSRFSGSGSGTDFTLTISSLQPEDFATYYCQQSYSTLTFGGGTKVEIK

SEQ ID NO: 921 - protein, 106 aa, Artificial Sequence; identical to SEQ ID NO: 735
  Synthetic construct

SEQ ID NO: 922 - protein, 106 aa, Artificial Sequence
  Synthetic construct
DIQMTQSPSTLSASVGDRVTITCRASQNVFTWLAWYQQKPGKAPRLLIYKASILESGVPSRFSGSGSGTDFTLTISSLQPEDFATYYCQQSYSTLTFGPGTKVDIK

SEQ ID NO: 923 - protein, 106 aa, Artificial Sequence; identical to SEQ ID NO: 704
  Synthetic construct

SEQ ID NO: 924 - protein, 106 aa, Artificial Sequence
  Synthetic construct
DIQMTQSPSSLSASVGDRVTITCRASQSISSYLNWYQQIPGKAPKLLIYAASSLQSGVPSRFSGSGSGTDFTLTISSLQPEDFATYYCQQSYSTLTFGGGTKVEIK

SEQ ID NO: 925 - protein, 106 aa, Artificial Sequence; identical to SEQ ID NO: 718
  Synthetic construct

SEQ ID NO: 926 - protein, 106 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPEDCATYYCQQSYSTLTFGGGTKVEIK

SEQ ID NO: 927 - protein, 106 aa, Artificial Sequence
  Synthetic construct
DIQMTQSPTSLSASVGDRVTITCRASQSITTYLNWYQQKPGKAPRLLIYTASSLQSGVPSRFSGSGSGTDFTLTISSLQLEDFATYYCQQSYSTLTFGPGTKVDIK

SEQ ID NO: 928 - protein, 106 aa, Artificial Sequence; identical to SEQ ID NO: 704
  Synthetic construct

SEQ ID NO: 929 - protein, 106 aa, Artificial Sequence
  Synthetic construct
DIQMTQSPPSLSASVGDRVTITCRASQSISSYLNWYQQKPGKAPKLLIYAASSLQSGVPSRFSGSGSGTDFTLTISSLQPEDFATYYCQQSYSTLTFGPGTKVEIK

SEQ ID NO: 930 - protein, 106 aa, Artificial Sequence; identical to SEQ ID NO: 704
  Synthetic construct

SEQ ID NO: 931 - protein, 53 aa, Artificial Sequence
  Synthetic construct
FQSGVPSRFGGSGSGTDFTLTISSLQPEDFATYYCQQSYSTLTFGGGTEVEIK

SEQ ID NO: 932 - protein, 80 aa, Artificial Sequence
  Synthetic construct
QSINSYLNWYQQKPGKAPRLLIHGTSTLQSGVPSTFSGSGSGTDFTLTINNLQPEDFATYYCQQSYSTLTFGGGTKVEIK

SEQ ID NO: 933 - protein, 106 aa, Artificial Sequence; identical to SEQ ID NO: 704
  Synthetic construct

SEQ ID NO: 934 - protein, 57 aa, Artificial Sequence; identical to SEQ ID NO: 820
  Synthetic construct

SEQ ID NO: 935 - protein, 106 aa, Artificial Sequence
  Synthetic construct
DIQMTQSPSSLSASVGDRVTITCRASQSISNYLNWYQQKPGEAPKLLIYAASSLESGVPSRFSGSGSGTDFTLTISSLQPEDLATYYCQQSYSTLTFGGGTKVEIK

SEQ ID NO: 936 - protein, 105 aa, Artificial Sequence
  Synthetic construct
DIQMTQSPSSLSASVGDRVTITCRASQSISSYLNWYQQKPGKAPKLLIYAASSLQSGVPSRFSGSGSGTDFTLTISSLQPVDFATYYCQQSYSTLTFGGGTKVEI

SEQ ID NO: 937 - protein, 106 aa, Artificial Sequence; identical to SEQ ID NO: 719
  Synthetic construct

SEQ ID NO: 938 - protein, 106 aa, Artificial Sequence; identical to SEQ ID NO: 735
  Synthetic construct

SEQ ID NO: 939 - protein, 106 aa, Artificial Sequence; identical to SEQ ID NO: 704
  Synthetic construct

SEQ ID NO: 940 - protein, 106 aa, Artificial Sequence; identical to SEQ ID NO: 704
  Synthetic construct

SEQ ID NO: 941 - protein, 106 aa, Artificial Sequence
  Synthetic construct
DIQMTQSPSSLSASVGDRVTVTCRASQNISNYLNWYQQKPGKAPKFLIYAASSLQSGVPSRFSGSGSGTDFTLTISSLQPEDFATYYCQQSYSTLTFGQGTRLEIK

SEQ ID NO: 942 - protein, 106 aa, Artificial Sequence; identical to SEQ ID NO: 719
  Synthetic construct

SEQ ID NO: 943 - protein, 106 aa, Artificial Sequence; identical to SEQ ID NO: 704
  Synthetic construct

SEQ ID NO: 944 - protein, 80 aa, Artificial Sequence
  Synthetic construct
QSISSYLNWYQQKPGKAPKLLIYAASSLQSGVPSRFSGSGSGTDFTLTISSLQPEDFATYYCQQSYSTLTFGQGTRLEIK

SEQ ID NO: 945 - protein, 106 aa, Artificial Sequence
  Synthetic construct
DIQMTQSPSSLSASVGDRVTITCRASQSISNYLNWYQQKPGKAPKLLIYAASSLQSGVPSRFSGSGSGTDFTLTISSLQPEDIATYYCQQSYNTLTFGPGTKVDIK

SEQ ID NO: 946 - protein, 106 aa, Artificial Sequence
  Synthetic construct
DIQMTQSPSSLSASVGDRGKRMCRASQSISNYVNWYQQKPGKAPKLLIYAASSLQSGVPSRFSGSGSGTDFTLTISTLQPDDIATYYCQQSYNTLTFGPGTKVDIK

SEQ ID NO: 947 - protein, 106 aa, Artificial Sequence; identical to SEQ ID NO: 234
  Synthetic construct

SEQ ID NO: 948 - protein, 106 aa, Artificial Sequence
  Synthetic construct
DIQMTQSPSSLSASVGDRVTITCRASQSISSYLNWYQQKPGKAPKVLIYAASSLQSGVPSRFSGSGSGADFTLTINSLQPEDFATYYCQQSYTTLTFGGGTKVEIK

SEQ ID NO: 949 - protein, 106 aa, Artificial Sequence
  Synthetic construct
DIQMTQSPSSVSASVGDRVTITCRASQDIGTWLAWYQQRPGRAPELLIYAASKLRSGVPSRFSGSGSGTDFTLTITSLKPEDFATYYCQQSYTTLTFGGGTKVEIK

SEQ ID NO: 950 - protein, 106 aa, Artificial Sequence; identical to SEQ ID NO: 948
  Synthetic construct

SEQ ID NO: 951 - protein, 106 aa, Artificial Sequence
  Synthetic construct
DIQMTQSPSSLSASVGDRVTITCRASQSISSYLNWYQQKPGKAPKVLTYAASSLQSGVPSRFSGSGSGADFTLTINSLQPEDFATYYCQQSYTTLTFGGGTKVEIK

SEQ ID NO: 952 - protein, 106 aa, Artificial Sequence; identical to SEQ ID NO: 948
  Synthetic construct

SEQ ID NO: 953 - protein, 106 aa, Artificial Sequence; identical to SEQ ID NO: 948
  Synthetic construct

SEQ ID NO: 954 - protein, 106 aa, Artificial Sequence; identical to SEQ ID NO: 948
  Synthetic construct

SEQ ID NO: 955 - protein, 106 aa, Artificial Sequence
  Synthetic construct
DIQMTQSPSSLSASVGDRVTITCRASQSISSYLNWYQQKPGKAPKVLIYAASSLQSGVPSRFSGSGSGADFTLTINSLQPEDFATYYCQQSYTTLTFGGGTKVETK

SEQ ID NO: 956 - protein, 106 aa, Artificial Sequence
  Synthetic construct
DIQMTQSPSSLSASVGDRVTITCRASQSISSYLNWYQQKPGKAPKVLIYAASSLQSGVPSRFSGSGSGADFTLTINGLQPEDFATYYCQQSYTTLTFGGGTKVEIK

SEQ ID NO: 957 - protein, 106 aa, Artificial Sequence; identical to SEQ ID NO: 948
  Synthetic construct

SEQ ID NO: 958 - protein, 106 aa, Artificial Sequence; identical to SEQ ID NO: 948
  Synthetic construct

SEQ ID NO: 959 - protein, 106 aa, Artificial Sequence; identical to SEQ ID NO: 948
  Synthetic construct

SEQ ID NO: 960 - protein, 106 aa, Artificial Sequence; identical to SEQ ID NO: 948
  Synthetic construct

SEQ ID NO: 961 - protein, 106 aa, Artificial Sequence
  Synthetic construct
DIQMTQSPSSLSASVGDRVTITCRASQSISNYLNWYQQKPGEAPKLLIYAASSLESGVPSRFSGSGSGTDFTLTISSLQPEDFATYYCQQSYTTLTFGGGTKVEIK

SEQ ID NO: 962 - protein, 106 aa, Artificial Sequence; identical to SEQ ID NO: 948
  Synthetic construct

SEQ ID NO: 963 - protein, 19 aa, Artificial Sequence
  Synthetic construct
CQQSYTTLTFGGGTKVEIK

SEQ ID NO: 964 - protein, 106 aa, Artificial Sequence; identical to SEQ ID NO: 238
  Synthetic construct

SEQ ID NO: 965 - protein, 79 aa, Artificial Sequence
  Synthetic construct
QDISAHLAWYQKKPGEAPKPLIYSASNLQSGVPSRFSGSGSGTEFTLIISSLQPEDFATYYCQQSYIAPTFGPGTNVDI

SEQ ID NO: 966 - protein, 105 aa, Artificial Sequence
  Synthetic construct
DIQMTQSPSSLSASVGDRVTITCRASQSISNYLNWYQQKPGKAPRLLIYAASNLQSGVPSRFSGSGSGTDFTLVISSLQPEDFATYYCQQSYIAPTFGPGTKVDI

SEQ ID NO: 967 - protein, 105 aa, Artificial Sequence; identical to SEQ ID NO: 966
  Synthetic construct

SEQ ID NO: 968 - protein, 105 aa, Artificial Sequence
  Synthetic construct
DIQMTQSPSSLSASVGDRVTLTCQASQDITHYLNWYQQKPGKAPNLLIYDASNLETGVPSRFSGSGSGTDFTLIISSLQPEDFATYYCQQSYIAPTFGPGTNVDI

SEQ ID NO: 969 - protein, 105 aa, Artificial Sequence
  Synthetic construct
DIQMTQSPSSLSASVGDRVTITCRASQSISNYLNWYQQKPGKAPRLLIYAASNLQSGVPSRFSGSGSGTDFTFVISSLQPEDFATYYCQQSYIAPTFGPGTKVDI

SEQ ID NO: 970 - protein, 106 aa, Artificial Sequence
  Synthetic construct
EVVLTQSPDFQSVTPKEKVTITCRASQSIGTNLHWYQRKPDQSPHLLIKYASQSMSGVPSRFSGSGSGTDFTLTISSLQPEDFATYFCQQSYNAGTFGQGTKVEIK

SEQ ID NO: 971 - protein, 106 aa, Artificial Sequence
  Synthetic construct
DIQMTQSPSSLSASVGDRVTIACRASQSISSYLNWYQQKPGKAPKLLIYAASGLQSGVPSRFSGSGPGTDFTLTISSLQPEDFATYFCQQSYNAGTFGQGTKVEIK

SEQ ID NO: 972 - protein, 106 aa, Artificial Sequence
  Synthetic construct
DIQMTQSPSSLSASVGDRVTITCRASQTIISYLNWYQQKAGKAPKLLIHAASSLQSGVPSRFSGSGSGTDFTLTISSLQPEDFATYYCQQSYITRTFGQGTKAEIK

SEQ ID NO: 973 - protein, 73 aa, Artificial Sequence
  Synthetic construct
LNWYQQKPGKAPTLLIYAASSLQFGVPSRFSGSGSGTHFTLTISSLQPEDFAAYYCQQSYGTATFGQGTKLEI

SEQ ID NO: 974 - protein, 106 aa, Artificial Sequence
  Synthetic construct
DIQMTQSPPSLSASVGDRVTIACRASQSISTYLNWYQQKPGKAPKLLIYAASSLLSGVPSRFSGSGSGTDFTLTISSLQPEDFATYYCQQSYRTLTFGPGTKVDIK

SEQ ID NO: 975 - protein, 106 aa, Artificial Sequence
  Synthetic construct
DIQMTQSPPSLSASVGDRVTIASRASQSISTYLNWYQQKPGKAPKLLIYAASSLLSGVPSRFSGSGSGTDFTLTISSLQPEDFATYYCQQSYRTLTFGPGTKVDIK

SEQ ID NO: 976 - protein, 107 aa, Artificial Sequence; identical to SEQ ID NO: 242
  Synthetic construct

SEQ ID NO: 977 - protein, 107 aa, Artificial Sequence
  Synthetic construct
EIVLTQSPDFQSVAPKEKVTITCRASQSIVTSLHWYQQKAGQSPRLLIKYASQSISGVPSRFSGSGSGTDFTLTISSLEAEDAAAYYCHQSTSLPYSFGQGTKLEIK

SEQ ID NO: 978 - protein, 107 aa, Artificial Sequence
  Synthetic construct
EIVLTQSPEFQPVTPKETLTITCRASEYIGTSLHWYQKKPDQSPKLLIKDASQSISGVPSRFSGSGSGTDFTLTINGLEPEDIATYYCHQSYSLPFAFGQGTKLEIK

SEQ ID NO: 979 - protein, 107 aa, Artificial Sequence; identical to SEQ ID NO: 978
  Synthetic construct

SEQ ID NO: 980 - protein, 107 aa, Artificial Sequence; identical to SEQ ID NO: 978
  Synthetic construct

SEQ ID NO: 981 - protein, 107 aa, Artificial Sequence; identical to SEQ ID NO: 978
  Synthetic construct

SEQ ID NO: 982 - protein, 107 aa, Artificial Sequence; identical to SEQ ID NO: 978
  Synthetic construct

SEQ ID NO: 983 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPFAFGQGTRLEIK

SEQ ID NO: 984 - protein, 81 aa, Artificial Sequence; identical to SEQ ID NO: 350
  Synthetic construct

SEQ ID NO: 985 - protein, 107 aa, Artificial Sequence
  Synthetic construct
EVVLTQSPDFQSVTPKENVTITCRASQSIGSSLHWYQQKPDQSPKLLIKYASQSISGVPSRFSGSGSGTDFTLTINSLEAEDAAAYYCHQSGSLPFTFGGGTKVEIK

SEQ ID NO: 986 - protein, 107 aa, Artificial Sequence; identical to SEQ ID NO: 985
  Synthetic construct

SEQ ID NO: 987 - protein, 81 aa, Artificial Sequence
  Synthetic construct
QSIGSSLHWYQQKPDQSPKLLIKYASQSISGVPSRFSGSGSGTDFTLTINSLEAEDAAAYYCHQSGSLPFTFGGGTKVEIK

SEQ ID NO: 988 - protein, 106 aa, Artificial Sequence
  Synthetic construct
EVVLTQSPDFQSVTPKENVTITCRASQSIGSSLHWYQQKPDQSPKLLTKYASQSISGVPSRFSGSGSGTDFTLTINSLEAEDAAAYYCHQSGSLPFTFGGGTKVEI

SEQ ID NO: 989 - protein, 80 aa, Artificial Sequence
  Synthetic construct
QSIGSSLHWYQQKPDHSPKLLIKSASQSFSGVPSRFSGSGSGTDFTLTINSLEPEDAATYYCHQSSSLPFTFGQGTKLEI

SEQ ID NO: 990 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPFTFGPGTKVDIK

SEQ ID NO: 991 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTLTINSLEPEDAATYYCHQSSSLPFTFGQRTKLEIK

SEQ ID NO: 992 - protein, 107 aa, Artificial Sequence
  Synthetic construct
EIVLTQSPDFLSVTPKDKVTITCRASQSIGSSLHWYQQKPDQSPKLLIKSASQSFSGVPSRFSGSGSGTDFTLTINSLEPEDAATYYCHQSSSLPFTFGQGTKLETK

SEQ ID NO: 993 - protein, 107 aa, Artificial Sequence
  Synthetic construct
EIVLTQSPDFQSVTPKDKVTITCRASQSIGSSLHWYQQKPDQSPKLLIKSASQPFSGVPSRFSGSGSGTDFTLTINSLEPEDAATYYCHQSSSLPFTFGQGTKLEIK

SEQ ID NO: 994 - protein, 107 aa, Artificial Sequence; identical to SEQ ID NO: 263
  Synthetic construct

SEQ ID NO: 995 - protein, 106 aa, Artificial Sequence
  Synthetic construct
EIVLTQSPDFQSVTPKDKVTITCRSQSIGSSLHWYQQKSDQSPKLLIKSASQSFSGVPSRFSGSGSGTDFTLTINSLEPEDAATYYCHQSSSLPFTFGQGTKLEIK

SEQ ID NO: 996 - protein, 107 aa, Artificial Sequence; identical to SEQ ID NO: 264
  Synthetic construct

SEQ ID NO: 997 - protein, 107 aa, Artificial Sequence; identical to SEQ ID NO: 265
  Synthetic construct

SEQ ID NO: 998 - protein, 78 aa, Artificial Sequence; identical to SEQ ID NO: 266
  Synthetic construct

SEQ ID NO: 999 - protein, 81 aa, Artificial Sequence
  Synthetic construct
QNIGSSLHWYQQKPGQSPKLLIRFASQSISGVPSRFSGSGSGTAFTLTISSLEAEDVATYYCHQSSSLPFTFGGGTKVEIK

SEQ ID NO: 1000 - protein, 107 aa, Artificial Sequence
  Synthetic construct
EIVLTQSPDFQSVTPKDKVTITCRASQSIGSSLHWYQQKLDQSPKLLIKSASQSFSGVPSRFSGSGSGTDFTLTINSLEPEDAATYYCHQSSSLPFTFGQGTKLEIK

SEQ ID NO: 1001 - protein, 107 aa, Artificial Sequence; identical to SEQ ID NO: 265
  Synthetic construct

SEQ ID NO: 1002 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTRTINSLEPEDAATYYCHQSSSLPFTFGQGTKLEIK

SEQ ID NO: 1003 - protein, 107 aa, Artificial Sequence; identical to SEQ ID NO: 268
  Synthetic construct

SEQ ID NO: 1004 - protein, 107 aa, Artificial Sequence; identical to SEQ ID NO: 265
  Synthetic construct

SEQ ID NO: 1005 - protein, 107 aa, Artificial Sequence; identical to SEQ ID NO: 265
  Synthetic construct

SEQ ID NO: 1006 - protein, 81 aa, Artificial Sequence; identical to SEQ ID NO: 271
  Synthetic construct

SEQ ID NO: 1007 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1008 - protein, 107 aa, Artificial Sequence; identical to SEQ ID NO: 1007
  Synthetic construct

SEQ ID NO: 1009 - protein, 107 aa, Artificial Sequence; identical to SEQ ID NO: 272
  Synthetic construct

SEQ ID NO: 1010 - protein, 107 aa, Artificial Sequence; identical to SEQ ID NO: 273
  Synthetic construct

SEQ ID NO: 1011 - protein, 107 aa, Artificial Sequence; identical to SEQ ID NO: 272
  Synthetic construct

SEQ ID NO: 1012 - protein, 107 aa, Artificial Sequence; identical to SEQ ID NO: 275
  Synthetic construct

SEQ ID NO: 1013 - protein, 107 aa, Artificial Sequence
  Synthetic construct
EIVLIQSPDFQSVTPKDKVTITCRASQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1014 - protein, 107 aa, Artificial Sequence; identical to SEQ ID NO: 1007
  Synthetic construct

SEQ ID NO: 1015 - protein, 107 aa, Artificial Sequence; identical to SEQ ID NO: 1007
  Synthetic construct

SEQ ID NO: 1016 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTLTINSLEPEDAVTYYCHQSSSLPFTFGQGTKLEIK

SEQ ID NO: 1017 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPFTFGGGTKVEIK

SEQ ID NO: 1018 - protein, 107 aa, Artificial Sequence; identical to SEQ ID NO: 276
  Synthetic construct

SEQ ID NO: 1019 - protein, 107 aa, Artificial Sequence; identical to SEQ ID NO: 1007
  Synthetic construct

SEQ ID NO: 1020 - protein, 107 aa, Artificial Sequence
  Synthetic construct
EIVLTQSPDFQSVTPKEKVTVTCRASQSIGSSLHWYQQKPDQSPKLLIKYASQSISGVPSRFSGSGSGTEFTLTINNLEAEDAAAYYCHQSSSLPFTFGGGTKVEIK

SEQ ID NO: 1021 - protein, 107 aa, Artificial Sequence; identical to SEQ ID NO: 265
  Synthetic construct

SEQ ID NO: 1022 - protein, 107 aa, Artificial Sequence
  Synthetic construct
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPFTFGGGTKVEIK

SEQ ID NO: 1023 - protein, 81 aa, Artificial Sequence
  Synthetic construct
QSIGSSLHWYQQKPDQSPKLLIKSASQSFSGVPSRFSGSGSGTDFTLTINSLEPEDAATYYCHQSSSLPFTFGQGTKLESK

SEQ ID NO: 1024 - protein, 107 aa, Artificial Sequence; identical to SEQ ID NO: 278
  Synthetic construct

SEQ ID NO: 1025 - protein, 107 aa, Artificial Sequence; identical to SEQ ID NO: 265
  Synthetic construct

SEQ ID NO: 1026 - protein, 107 aa, Artificial Sequence; identical to SEQ ID NO: 275
  Synthetic construct

SEQ ID NO: 1027 - protein, 107 aa, Artificial Sequence; identical to SEQ ID NO: 1007
  Synthetic construct

SEQ ID NO: 1028 - protein, 107 aa, Artificial Sequence; identical to SEQ ID NO: 1007
  Synthetic construct

SEQ ID NO: 1029 - protein, 107 aa, Artificial Sequence
  Synthetic construct
AIRMTQSPSPLSASTGDRVTITCRASQHISSYLAWYQQKPGKAPRLLIYSASTLQSGVPSRFSGSGSGTDFTLTINSLEPEDAATYYCHQSSSLPFTFGQGTKLEIK

SEQ ID NO: 1030 - protein, 107 aa, Artificial Sequence; identical to SEQ ID NO: 1007
  Synthetic construct

SEQ ID NO: 1031 - protein, 81 aa, Artificial Sequence; identical to SEQ ID NO: 281
  Synthetic construct

SEQ ID NO: 1032 - protein, 107 aa, Artificial Sequence; identical to SEQ ID NO: 265
  Synthetic construct

SEQ ID NO: 1033 - protein, 107 aa, Artificial Sequence; identical to SEQ ID NO: 272
  Synthetic construct

SEQ ID NO: 1034 - protein, 81 aa, Artificial Sequence; identical to SEQ ID NO: 271
  Synthetic construct

SEQ ID NO: 1035 - protein, 107 aa, Artificial Sequence; identical to SEQ ID NO: 285
  Synthetic construct

SEQ ID NO: 1036 - protein, 81 aa, Artificial Sequence; identical to SEQ ID NO: 286
  Synthetic construct

SEQ ID NO: 1037 - protein, 107 aa, Artificial Sequence; identical to SEQ ID NO: 1007
  Synthetic construct

SEQ ID NO: 1038 - protein, 107 aa, Artificial Sequence; identical to SEQ ID NO: 1007
  Synthetic construct

SEQ ID NO: 1039 - protein, 107 aa, Artificial Sequence; identical to SEQ ID NO: 264
  Synthetic construct

SEQ ID NO: 1040 - protein, 107 aa, Artificial Sequence; identical to SEQ ID NO: 288
  Synthetic construct

SEQ ID NO: 1041 - protein, 107 aa, Artificial Sequence; identical to SEQ ID NO: 289
  Synthetic construct

SEQ ID NO: 1042 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTLTINSLEPEGAATYYCHQSSSLPFTFGQGTKLEIK

SEQ ID NO: 1043 - protein, 107 aa, Artificial Sequence
  Synthetic construct
EIVLTQSPDFQSVTPKDKVTITCRARQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1044 - protein, 107 aa, Artificial Sequence; identical to SEQ ID NO: 1007
  Synthetic construct

SEQ ID NO: 1045 - protein, 107 aa, Artificial Sequence; identical to SEQ ID NO: 272
  Synthetic construct

SEQ ID NO: 1046 - protein, 107 aa, Artificial Sequence; identical to SEQ ID NO: 291
  Synthetic construct

SEQ ID NO: 1047 - protein, 107 aa, Artificial Sequence; identical to SEQ ID NO: 1007
  Synthetic construct

SEQ ID NO: 1048 - protein, 20 aa, Artificial Sequence
  Synthetic construct
CHQSSSLPFTFGPGTKVDIK

SEQ ID NO: 1049 - protein, 81 aa, Artificial Sequence; identical to SEQ ID NO: 293
  Synthetic construct

SEQ ID NO: 1050 - protein, 107 aa, Artificial Sequence
  Synthetic construct
EVVLTQSPESQSVTPKETVTITCRASQNIGSSLHWYQQKPGQSPKLLIRFASQSISGVPSRFSGSGSGTAFTLTISSLEAEDVATYYCHQSSSLPFTFGGGTKVEIK

SEQ ID NO: 1051 - protein, 20 aa, Artificial Sequence
  Synthetic construct
CHQSSSLPFTFGPGTKLDLK

SEQ ID NO: 1052 - protein, 107 aa, Artificial Sequence; identical to SEQ ID NO: 295
  Synthetic construct

SEQ ID NO: 1053 - protein, 107 aa, Artificial Sequence; identical to SEQ ID NO: 1007
  Synthetic construct

SEQ ID NO: 1054 - protein, 107 aa, Artificial Sequence; identical to SEQ ID NO: 264
  Synthetic construct

SEQ ID NO: 1055 - protein, 107 aa, Artificial Sequence; identical to SEQ ID NO: 275
  Synthetic construct

SEQ ID NO: 1056 - protein, 107 aa, Artificial Sequence; identical to SEQ ID NO: 265
  Synthetic construct

SEQ ID NO: 1057 - protein, 107 aa, Artificial Sequence; identical to SEQ ID NO: 299
  Synthetic construct

SEQ ID NO: 1058 - protein, 107 aa, Artificial Sequence; identical to SEQ ID NO: 1007
  Synthetic construct

SEQ ID NO: 1059 - protein, 80 aa, Artificial Sequence
  Synthetic construct
QSIGTSLHWYQQKPDQSPKLLIKYASQSFSGVPSRFSGSGSGADFTLTINSLEAEDAATYFCHQSSSLPFTFGGGTRVEI

SEQ ID NO: 1060 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTLTINSLEPEDAAPYYCHQSSSLPFTFGQGTKLEIK

SEQ ID NO: 1061 - protein, 107 aa, Artificial Sequence
  Synthetic construct
EIVLTQSPDFQSVTPKEKVTITCRASQSIGTSLHWYQQKPDQSPKLLIKYASQSISGVPSRFSGSGSGTEFTLTINSLEAEDAAAYYCHQSSSLPFTFGGGTKVEIK

SEQ ID NO: 1062 - protein, 107 aa, Artificial Sequence; identical to SEQ ID NO: 1007
  Synthetic construct

SEQ ID NO: 1063 - protein, 20 aa, Artificial Sequence
  Synthetic construct
CHQSSSLPFTFGQGTKLEIK

SEQ ID NO: 1064 - protein, 107 aa, Artificial Sequence; identical to SEQ ID NO: 275
  Synthetic construct

SEQ ID NO: 1065 - protein, 107 aa, Artificial Sequence
  Synthetic construct
EIVSTQSPDFQSVTPKDKVTITCRASQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1066 - protein, 107 aa, Artificial Sequence; identical to SEQ ID NO: 301
  Synthetic construct

SEQ ID NO: 1067 - protein, 107 aa, Artificial Sequence; identical to SEQ ID NO: 275
  Synthetic construct

SEQ ID NO: 1068 - protein, 107 aa, Artificial Sequence; identical to SEQ ID NO: 1020
  Synthetic construct

SEQ ID NO: 1069 - protein, 107 aa, Artificial Sequence; identical to SEQ ID NO: 1007
  Synthetic construct

SEQ ID NO: 1070 - protein, 107 aa, Artificial Sequence
  Synthetic construct
EIVLTRSPDFQSVTPKDKVTITCRASQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1071 - protein, 107 aa, Artificial Sequence; identical to SEQ ID NO: 275
  Synthetic construct

SEQ ID NO: 1072 - protein, 107 aa, Artificial Sequence; identical to SEQ ID NO: 1022
  Synthetic construct

SEQ ID NO: 1073 - protein, 20 aa, Artificial Sequence
  Synthetic construct
CHQSSSLPFTFGQGTRLEIK

SEQ ID NO: 1074 - protein, 107 aa, Artificial Sequence; identical to SEQ ID NO: 299
  Synthetic construct

SEQ ID NO: 1075 - protein, 107 aa, Artificial Sequence; identical to SEQ ID NO: 1007
  Synthetic construct

SEQ ID NO: 1076 - protein, 107 aa, Artificial Sequence; identical to SEQ ID NO: 275
  Synthetic construct

SEQ ID NO: 1077 - protein, 107 aa, Artificial Sequence; identical to SEQ ID NO: 264
  Synthetic construct

SEQ ID NO: 1078 - protein, 107 aa, Artificial Sequence
  Synthetic construct
EIVLTQSPDFQSVTPKDKVTITCRASQSIGSSLHWYQQKPVQSPKLLIKSASQSFSGVPSRFSGSGSGTDFTLTINSLEPEDAATYYCHQSSSLPFTFGQGTKRESK

SEQ ID NO: 1079 - protein, 107 aa, Artificial Sequence; identical to SEQ ID NO: 1007
  Synthetic construct

SEQ ID NO: 1080 - protein, 107 aa, Artificial Sequence; identical to SEQ ID NO: 1007
  Synthetic construct

SEQ ID NO: 1081 - protein, 81 aa, Artificial Sequence; identical to SEQ ID NO: 307
  Synthetic construct

SEQ ID NO: 1082 - protein, 107 aa, Artificial Sequence; identical to SEQ ID NO: 265
  Synthetic construct

SEQ ID NO: 1083 - protein, 107 aa, Artificial Sequence; identical to SEQ ID NO: 1007
  Synthetic construct

SEQ ID NO: 1084 - protein, 107 aa, Artificial Sequence; identical to SEQ ID NO: 272
  Synthetic construct

SEQ ID NO: 1085 - protein, 107 aa, Artificial Sequence; identical to SEQ ID NO: 299
  Synthetic construct

SEQ ID NO: 1086 - protein, 107 aa, Artificial Sequence; identical to SEQ ID NO: 265
  Synthetic construct

SEQ ID NO: 1087 - protein, 107 aa, Artificial Sequence
  Synthetic construct
EIVLTQSPDFQSVTPKEKVTVTCRASQSIGSSLHWYQQKPDQSPKLLIKYASQSISGVPSRFSGSGSGTESTLTINNLEAEDAAAYYCHQSSSLPFTFGGGTKVEIK

SEQ ID NO: 1088 - protein, 107 aa, Artificial Sequence; identical to SEQ ID NO: 1007
  Synthetic construct

SEQ ID NO: 1089 - protein, 107 aa, Artificial Sequence; identical to SEQ ID NO: 990
  Synthetic construct

SEQ ID NO: 1090 - protein, 107 aa, Artificial Sequence; identical to SEQ ID NO: 1007
  Synthetic construct

SEQ ID NO: 1091 - protein, 107 aa, Artificial Sequence; identical to SEQ ID NO: 264
  Synthetic construct

SEQ ID NO: 1092 - protein, 107 aa, Artificial Sequence; identical to SEQ ID NO: 1007
  Synthetic construct

SEQ ID NO: 1093 - protein, 81 aa, Artificial Sequence
  Synthetic construct
QSIGSSLHWYQQKPDQSPKLLIRSASQSFSGVPSRFSGSGSGTDFTLTINSLEPEDAATYYCHQSSSLPFTFGQGTKLEIK

SEQ ID NO: 1094 - protein, 107 aa, Artificial Sequence
  Synthetic construct
EIVLTQSPDFQSVTPKDKVTITCRASQSIGSSLHWYQQKPDQSPKLLIESASQSFSGVPSRFSGSGSGTDFTLTINSLEPEDAATYYCHQSSSLPFTFGQGTKLEIK

SEQ ID NO: 1095 - protein, 55 aa, Artificial Sequence
  Synthetic construct
QSFSGVPSRFSGSGSGTDFTLTINSLEPEDAATYYCHQSSSLPFTFGQGTKLEIK

SEQ ID NO: 1096 - protein, 107 aa, Artificial Sequence; identical to SEQ ID NO: 1007
  Synthetic construct

SEQ ID NO: 1097 - protein, 107 aa, Artificial Sequence; identical to SEQ ID NO: 265
  Synthetic construct

SEQ ID NO: 1098 - protein, 107 aa, Artificial Sequence
  Synthetic construct
EIVLTQSQDFQSVTPKEKVTITCRASQSIGSSLHWYQQKPDQSPKLLIKYASQSFSGVPSRFSGSGSGTDFTLTINSLEAEDAATYYCHQSSSLPFTFGGGTKVEIK

SEQ ID NO: 1099 - protein, 107 aa, Artificial Sequence; identical to SEQ ID NO: 1007
  Synthetic construct

SEQ ID NO: 1100 - protein, 107 aa, Artificial Sequence; identical to SEQ ID NO: 314
  Synthetic construct

SEQ ID NO: 1101 - protein, 107 aa, Artificial Sequence; identical to SEQ ID NO: 1007
  Synthetic construct

SEQ ID NO: 1102 - protein, 81 aa, Artificial Sequence
  Synthetic construct
QSIGSSLHWYQQKPDQSPKLLIKSASQSFSGVPSRFSGSGSGTDFTLTINSLEPEDAATYYCHQSSSLPFTFGQGTKLEIK

SEQ ID NO: 1103 - protein, 107 aa, Artificial Sequence; identical to SEQ ID NO: 265
  Synthetic construct

SEQ ID NO: 1104 - protein, 107 aa, Artificial Sequence; identical to SEQ ID NO: 316
  Synthetic construct

SEQ ID NO: 1105 - protein, 107 aa, Artificial Sequence; identical to SEQ ID NO: 1007
  Synthetic construct

SEQ ID NO: 1106 - protein, 107 aa, Artificial Sequence; identical to SEQ ID NO: 1007
  Synthetic construct

SEQ ID NO: 1107 - protein, 107 aa, Artificial Sequence; identical to SEQ ID NO: 317
  Synthetic construct

SEQ ID NO: 1108 - protein, 107 aa, Artificial Sequence; identical to SEQ ID NO: 264
  Synthetic construct

SEQ ID NO: 1109 - protein, 107 aa, Artificial Sequence; identical to SEQ ID NO: 1007
  Synthetic construct

SEQ ID NO: 1110 - protein, 81 aa, Artificial Sequence; identical to SEQ ID NO: 1102
  Synthetic construct

SEQ ID NO: 1111 - protein, 107 aa, Artificial Sequence; identical to SEQ ID NO: 264
  Synthetic construct

SEQ ID NO: 1112 - protein, 20 aa, Artificial Sequence
  Synthetic construct
CHQSSSLPFTFGPGTKVDIK

SEQ ID NO: 1113 - protein, 107 aa, Artificial Sequence; identical to SEQ ID NO: 1007
  Synthetic construct

SEQ ID NO: 1114 - protein, 81 aa, Artificial Sequence; identical to SEQ ID NO: 1102
  Synthetic construct

SEQ ID NO: 1115 - protein, 106 aa, Artificial Sequence
  Synthetic construct
EIVLTQSPDFQSVTPKDKVTITCRASQSIGSSHWYQQKPDQSPKLLIKSASQSFSGVPSRFSGSGSGTDFTLTINSLEPEDAATYYCHQSSSLPFTFGQGTKLEIK

SEQ ID NO: 1116 - protein, 107 aa, Artificial Sequence; identical to SEQ ID NO: 265
  Synthetic construct

SEQ ID NO: 1117 - protein, 107 aa, Artificial Sequence; identical to SEQ ID NO: 1007
  Synthetic construct

SEQ ID NO: 1118 - protein, 107 aa, Artificial Sequence; identical to SEQ ID NO: 265
  Synthetic construct

SEQ ID NO: 1119 - protein, 107 aa, Artificial Sequence
  Synthetic construct
EVVLTQSPESQSVTPKETVTMTCRASQNIGRSLHWYQQKPGQSPKLLIRFASQSISGVPSRFSGSGSGTAFTLTISSLEAEDVATYYCHQSSSLPFTFGGGTKVEIK

SEQ ID NO: 1120 - protein, 107 aa, Artificial Sequence
  Synthetic construct
EIVLTQSPDLQSVTPKDKVTITCRASQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1121 - protein, 107 aa, Artificial Sequence; identical to SEQ ID NO: 323
  Synthetic construct

SEQ ID NO: 1122 - protein, 107 aa, Artificial Sequence; identical to SEQ ID NO: 1007
  Synthetic construct

SEQ ID NO: 1123 - protein, 107 aa, Artificial Sequence; identical to SEQ ID NO: 324
  Synthetic construct

SEQ ID NO: 1124 - protein, 81 aa, Artificial Sequence; identical to SEQ ID NO: 1102
  Synthetic construct

SEQ ID NO: 1125 - protein, 107 aa, Artificial Sequence; identical to SEQ ID NO: 265
  Synthetic construct

SEQ ID NO: 1126 - protein, 107 aa, Artificial Sequence; identical to SEQ ID NO: 326
  Synthetic construct

SEQ ID NO: 1127 - protein, 81 aa, Artificial Sequence; identical to SEQ ID NO: 293
  Synthetic construct

SEQ ID NO: 1128 - protein, 107 aa, Artificial Sequence; identical to SEQ ID NO: 1007
  Synthetic construct

SEQ ID NO: 1129 - protein, 113 aa, Artificial Sequence
  Synthetic construct
DIVMTQSPDSLAVSLGERATINCKSSQSVLYSSNNKNSLAWYQQKPGQPPKLLIYWASTRESGVPDRFSGSGSGTDFTLTINSLEAEDAATYYCHQSSSLPFTFGPGTKVDIK

SEQ ID NO: 1130 - protein, 107 aa, Artificial Sequence; identical to SEQ ID NO: 1007
  Synthetic construct

SEQ ID NO: 1131 - protein, 107 aa, Artificial Sequence; identical to SEQ ID NO: 275
  Synthetic construct

SEQ ID NO: 1132 - protein, 107 aa, Artificial Sequence; identical to SEQ ID NO: 1050
  Synthetic construct

SEQ ID NO: 1133 - protein, 58 aa, Artificial Sequence; identical to SEQ ID NO: 329
  Synthetic construct

SEQ ID NO: 1134 - protein, 107 aa, Artificial Sequence; identical to SEQ ID NO: 330
  Synthetic construct

SEQ ID NO: 1135 - protein, 107 aa, Artificial Sequence; identical to SEQ ID NO: 331
  Synthetic construct

SEQ ID NO: 1136 - protein, 107 aa, Artificial Sequence; identical to SEQ ID NO: 265
  Synthetic construct

SEQ ID NO: 1137 - protein, 107 aa, Artificial Sequence; identical to SEQ ID NO: 264
  Synthetic construct

SEQ ID NO: 1138 - protein, 107 aa, Artificial Sequence; identical to SEQ ID NO: 334
  Synthetic construct

SEQ ID NO: 1139 - protein, 20 aa, Artificial Sequence
  Synthetic construct
CHQSSSLPFTFGPGTKVDIK

SEQ ID NO: 1140 - protein, 107 aa, Artificial Sequence; identical to SEQ ID NO: 336
  Synthetic construct

SEQ ID NO: 1141 - protein, 107 aa, Artificial Sequence
  Synthetic construct
EVVLTQSPESQSVTPKETVTMTCRASQNIGRSLHWYQQKPGQSPKLLIRFASHSISGVPSRFSGSGSGTAFTLTISSLEAEDVATYYCHQSSSLPFTFGGGTKVEIK

SEQ ID NO: 1142 - protein, 81 aa, Artificial Sequence
  Synthetic construct
QSIGSSLHWYQQKPDQSPKLLIKSASQSFSGVPSRFGGSGSGTDFTLTINSLEPEDAATYYCHQSSSLPFTFGQGTKLEIK

SEQ ID NO: 1143 - protein, 107 aa, Artificial Sequence
  Synthetic construct
EIVLTQSPDFQSVTPKDKVTITCRASQSIGSSLHWYQQKPDQSPKLLIKSASQSFSGVPSRFSGSGSGTDFTLTINSLEPEDAATYYCHQSSSLPFTFGLGTKLEIK

SEQ ID NO: 1144 - protein, 107 aa, Artificial Sequence
  Synthetic construct
EIVLTQPPDFQSVTPKDKVTITCRASQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1145 - protein, 107 aa, Artificial Sequence; identical to SEQ ID NO: 265
  Synthetic construct

SEQ ID NO: 1146 - protein, 107 aa, Artificial Sequence; identical to SEQ ID NO: 264
  Synthetic construct

SEQ ID NO: 1147 - protein, 107 aa, Artificial Sequence
  Synthetic construct
EIVLTQSPDFQSVTPKDKVTTTCRASQSIGSSLHWYQQKPDQSPKLLIKSASQSFSGVPSRFSGSGSGTDFTLTINSLEPEDAATYYCHQSSSLPFTFGQGTKLEIK

SEQ ID NO: 1148 - protein, 107 aa, Artificial Sequence; identical to SEQ ID NO: 264
  Synthetic construct

SEQ ID NO: 1149 - protein, 107 aa, Artificial Sequence; identical to SEQ ID NO: 1007
  Synthetic construct

SEQ ID NO: 1150 - protein, 78 aa, Artificial Sequence; identical to SEQ ID NO: 266
  Synthetic construct

SEQ ID NO: 1151 - protein, 107 aa, Artificial Sequence; identical to SEQ ID NO: 341
  Synthetic construct

SEQ ID NO: 1152 - protein, 106 aa, Artificial Sequence
  Synthetic construct
EIVLTQSPDFQSVTPKEKVTITCRASQSIGTSLHWYQQKPDQSPKLLIKYASQSFSGVPSRFSGSGSGADFTLTINSLEAEDAATYFCHQSSSLPFTFGGGTRVEI

SEQ ID NO: 1153 - protein, 107 aa, Artificial Sequence; identical to SEQ ID NO: 342
  Synthetic construct

SEQ ID NO: 1154 - protein, 107 aa, Artificial Sequence
  Synthetic construct
EIVLTQSPDFQSVTSKDKVTITCRASQSIGSSLHWYQQKPDQSPKLLIKSASQSFSRVPSRFSGSGSETDFTLTINSLEPEDAATYYCHQSSSLPFTFGQGTKLEIK

SEQ ID NO: 1155 - protein, 107 aa, Artificial Sequence; identical to SEQ ID NO: 1061
  Synthetic construct

SEQ ID NO: 1156 - protein, 107 aa, Artificial Sequence; identical to SEQ ID NO: 343
  Synthetic construct

SEQ ID NO: 1157 - protein, 107 aa, Artificial Sequence; identical to SEQ ID NO: 990
  Synthetic construct

SEQ ID NO: 1158 - protein, 107 aa, Artificial Sequence; identical to SEQ ID NO: 264
  Synthetic construct

SEQ ID NO: 1159 - protein, 81 aa, Artificial Sequence; identical to SEQ ID NO: 345
  Synthetic construct

SEQ ID NO: 1160 - protein, 107 aa, Artificial Sequence
  Synthetic construct
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPYPFGQGTKLEIK

SEQ ID NO: 1161 - protein, 107 aa, Artificial Sequence
  Synthetic construct
EIVLTQSPDFQSVTPKEKVTITCRASQSIGSSLHWYQQKPDQSPKLLIKYASQSISGVPSRFSGSGSGTDFTLTINSLEAEDAATYYCHQSSSLPQAFGQGTKVEIK

SEQ ID NO: 1162 - protein, 58 aa, Artificial Sequence
  Synthetic construct
YASQSMSGVPSRFSGSGSGTDFTLTINSLEAEDAATYYCHQSSSLPQAFGQGTKVEIK

SEQ ID NO: 1163 - protein, 107 aa, Artificial Sequence
  Synthetic construct
EIVLTQSPDFQSVTPKEKVTITCRASQSIGSSLHWYQQKPDQPPKLLIKYASQSISGVPSRFSGSGSGTDFTLTINSLEAEDAAAYYCHQSSSLPQAFGQGTKVEIK

SEQ ID NO: 1164 - protein, 75 aa, Artificial Sequence
  Synthetic construct
LHWYQHKPDQSPRLLIKYASQSMSGVPSRFSGSGSGTDFTLTINSLEAEDAATYYCHQSSSLPQAFGQGTKVEIK

SEQ ID NO: 1165 - protein, 107 aa, Artificial Sequence
  Synthetic construct
EIVLTQSPDFQSVTPKEKVTITCRASQSIGSSLHWYQQKPDQSPKLLIKYASQSFSGVPSRFSGSGSGTDFTLTINSLEAEVAATYYCHQSSSLPQAFGQGTKVEIK

SEQ ID NO: 1166 - protein, 107 aa, Artificial Sequence; identical to SEQ ID NO: 258
  Synthetic construct

SEQ ID NO: 1167 - protein, 107 aa, Artificial Sequence
  Synthetic construct
EIVLTQSPDFQSVTPKEKVTITCRASQSVGSDLHWYQQKADQSPKLLIKHASQSFTGVPSRFSGSGSGTEFTLTINGLEAEDAATYYCHQSASLPQAFGQGTKLEIK

SEQ ID NO: 1168 - protein, 107 aa, Artificial Sequence
  Synthetic construct
EIVLTQSPDFQSVTPKEKVTITCRASQNIGTSLHWYQQKPGQSPRLLIKSASQSFSGVPSKFSGSGYGTDFTLTINGLEPEDAATYYCHQSSSLPYSFGPGTKLEIK

SEQ ID NO: 1169 - protein, 104 aa, Artificial Sequence
  Synthetic construct
EVVLTQSPGFQSVTPKEAVTITCRASLSIGNNLHWYQQKPGQSPSLLIKSASQPMSGVPSRFSGSGSGTDFTLTINSLEVEDAATYYCHQSKSLPLAFGGGTKV

SEQ ID NO: 1170 - protein, 108 aa, Artificial Sequence; identical to SEQ ID NO: 351
  Synthetic construct

SEQ ID NO: 1171 - protein, 113 aa, Artificial Sequence; identical to SEQ ID NO: 574
  Synthetic construct

SEQ ID NO: 1172 - protein, 113 aa, Artificial Sequence; identical to SEQ ID NO: 575
  Synthetic construct

SEQ ID NO: 1173 - protein, 113 aa, Artificial Sequence; identical to SEQ ID NO: 433
  Synthetic construct

SEQ ID NO: 1174 - protein, 112 aa, Artificial Sequence; identical to SEQ ID NO: 434
  Synthetic construct

SEQ ID NO: 1175 - protein, 113 aa, Artificial Sequence; identical to SEQ ID NO: 435
  Synthetic construct

SEQ ID NO: 1176 - protein, 113 aa, Artificial Sequence; identical to SEQ ID NO: 436
  Synthetic construct

SEQ ID NO: 1177 - protein, 113 aa, Artificial Sequence; identical to SEQ ID NO: 437
  Synthetic construct

SEQ ID NO: 1178 - protein, 113 aa, Artificial Sequence; identical to SEQ ID NO: 438
  Synthetic construct

SEQ ID NO: 1179 - protein, 108 aa, Artificial Sequence; identical to SEQ ID NO: 439
  Synthetic construct

SEQ ID NO: 1180 - protein, 113 aa, Artificial Sequence; identical to SEQ ID NO: 438
  Synthetic construct

SEQ ID NO: 1181 - protein, 113 aa, Artificial Sequence; identical to SEQ ID NO: 441
  Synthetic construct

SEQ ID NO: 1182 - protein, 113 aa, Artificial Sequence; identical to SEQ ID NO: 438
  Synthetic construct

SEQ ID NO: 1183 - protein, 113 aa, Artificial Sequence; identical to SEQ ID NO: 438
  Synthetic construct

SEQ ID NO: 1184 - protein, 113 aa, Artificial Sequence; identical to SEQ ID NO: 438
  Synthetic construct

SEQ ID NO: 1185 - protein, 113 aa, Artificial Sequence; identical to SEQ ID NO: 438
  Synthetic construct

SEQ ID NO: 1186 - protein, 113 aa, Artificial Sequence; identical to SEQ ID NO: 438
  Synthetic construct

SEQ ID NO: 1187 - protein, 108 aa, Artificial Sequence; identical to SEQ ID NO: 447
  Synthetic construct

SEQ ID NO: 1188 - protein, 108 aa, Artificial Sequence; identical to SEQ ID NO: 448
  Synthetic construct

SEQ ID NO: 1189 - protein, 87 aa, Artificial Sequence; identical to SEQ ID NO: 449
  Synthetic construct

SEQ ID NO: 1190 - protein, 113 aa, Artificial Sequence; identical to SEQ ID NO: 438
  Synthetic construct

SEQ ID NO: 1191 - protein, 113 aa, Artificial Sequence; identical to SEQ ID NO: 438
  Synthetic construct

SEQ ID NO: 1192 - protein, 58 aa, Artificial Sequence
  Synthetic construct
AASSLHSGVPSRFSGSGSGTDFTFTISSLQAEDVAVYYCQHFYSNPPTFGPGTTVAIK

SEQ ID NO: 1193 - protein, 113 aa, Artificial Sequence; identical to SEQ ID NO: 435
  Synthetic construct

SEQ ID NO: 1194 - protein, 113 aa, Artificial Sequence; identical to SEQ ID NO: 453
  Synthetic construct

SEQ ID NO: 1195 - protein, 108 aa, Artificial Sequence; identical to SEQ ID NO: 447
  Synthetic construct

SEQ ID NO: 1196 - protein, 113 aa, Artificial Sequence; identical to SEQ ID NO: 438
  Synthetic construct

SEQ ID NO: 1197 - protein, 113 aa, Artificial Sequence; identical to SEQ ID NO: 438
  Synthetic construct

SEQ ID NO: 1198 - protein, 113 aa, Artificial Sequence; identical to SEQ ID NO: 438
  Synthetic construct

SEQ ID NO: 1199 - protein, 113 aa, Artificial Sequence; identical to SEQ ID NO: 438
  Synthetic construct

SEQ ID NO: 1200 - protein, 113 aa, Artificial Sequence; identical to SEQ ID NO: 438
  Synthetic construct

SEQ ID NO: 1201 - protein, 75 aa, Artificial Sequence; identical to SEQ ID NO: 460
  Synthetic construct

SEQ ID NO: 1202 - protein, 113 aa, Artificial Sequence; identical to SEQ ID NO: 461
  Synthetic construct

SEQ ID NO: 1203 - protein, 113 aa, Artificial Sequence; identical to SEQ ID NO: 438
  Synthetic construct

SEQ ID NO: 1204 - protein, 113 aa, Artificial Sequence; identical to SEQ ID NO: 463
  Synthetic construct

SEQ ID NO: 1205 - protein, 113 aa, Artificial Sequence; identical to SEQ ID NO: 438
  Synthetic construct

SEQ ID NO: 1206 - protein, 113 aa, Artificial Sequence; identical to SEQ ID NO: 465
  Synthetic construct

SEQ ID NO: 1207 - protein, 113 aa, Artificial Sequence; identical to SEQ ID NO: 466
  Synthetic construct

SEQ ID NO: 1208 - protein, 113 aa, Artificial Sequence; identical to SEQ ID NO: 467
  Synthetic construct

SEQ ID NO: 1209 - protein, 113 aa, Artificial Sequence; identical to SEQ ID NO: 438
  Synthetic construct

SEQ ID NO: 1210 - protein, 113 aa, Artificial Sequence; identical to SEQ ID NO: 469
  Synthetic construct

SEQ ID NO: 1211 - protein, 113 aa, Artificial Sequence; identical to SEQ ID NO: 438
  Synthetic construct

SEQ ID NO: 1212 - protein, 113 aa, Artificial Sequence; identical to SEQ ID NO: 471
  Synthetic construct

SEQ ID NO: 1213 - protein, 108 aa, Artificial Sequence; identical to SEQ ID NO: 447
  Synthetic construct

SEQ ID NO: 1214 - protein, 113 aa, Artificial Sequence; identical to SEQ ID NO: 438
  Synthetic construct

SEQ ID NO: 1215 - protein, 113 aa, Artificial Sequence; identical to SEQ ID NO: 438
  Synthetic construct

SEQ ID NO: 1216 - protein, 113 aa, Artificial Sequence; identical to SEQ ID NO: 438
  Synthetic construct

SEQ ID NO: 1217 - protein, 58 aa, Artificial Sequence; identical to SEQ ID NO: 476
  Synthetic construct

SEQ ID NO: 1218 - protein, 113 aa, Artificial Sequence; identical to SEQ ID NO: 438
  Synthetic construct

SEQ ID NO: 1219 - protein, 53 aa, Artificial Sequence; identical to SEQ ID NO: 478
  Synthetic construct

SEQ ID NO: 1220 - protein, 113 aa, Artificial Sequence; identical to SEQ ID NO: 479
  Synthetic construct

SEQ ID NO: 1221 - protein, 113 aa, Artificial Sequence; identical to SEQ ID NO: 438
  Synthetic construct

SEQ ID NO: 1222 - protein, 108 aa, Artificial Sequence; identical to SEQ ID NO: 481
  Synthetic construct

SEQ ID NO: 1223 - protein, 113 aa, Artificial Sequence; identical to SEQ ID NO: 482
  Synthetic construct

SEQ ID NO: 1224 - protein, 113 aa, Artificial Sequence; identical to SEQ ID NO: 438
  Synthetic construct

SEQ ID NO: 1225 - protein, 113 aa, Artificial Sequence; identical to SEQ ID NO: 484
  Synthetic construct

SEQ ID NO: 1226 - protein, 113 aa, Artificial Sequence; identical to SEQ ID NO: 485
  Synthetic construct

SEQ ID NO: 1227 - protein, 113 aa, Artificial Sequence; identical to SEQ ID NO: 486
  Synthetic construct

SEQ ID NO: 1228 - protein, 58 aa, Artificial Sequence; identical to SEQ ID NO: 476
  Synthetic construct

SEQ ID NO: 1229 - protein, 113 aa, Artificial Sequence; identical to SEQ ID NO: 438
  Synthetic construct

SEQ ID NO: 1230 - protein, 113 aa, Artificial Sequence; identical to SEQ ID NO: 438
  Synthetic construct

SEQ ID NO: 1231 - protein, 113 aa, Artificial Sequence; identical to SEQ ID NO: 490
  Synthetic construct

SEQ ID NO: 1232 - protein, 113 aa, Artificial Sequence; identical to SEQ ID NO: 491
  Synthetic construct

SEQ ID NO: 1233 - protein, 113 aa, Artificial Sequence; identical to SEQ ID NO: 492
  Synthetic construct

SEQ ID NO: 1234 - protein, 113 aa, Artificial Sequence; identical to SEQ ID NO: 438
  Synthetic construct

SEQ ID NO: 1235 - protein, 113 aa, Artificial Sequence; identical to SEQ ID NO: 494
  Synthetic construct

SEQ ID NO: 1236 - protein, 113 aa, Artificial Sequence; identical to SEQ ID NO: 438
  Synthetic construct

SEQ ID NO: 1237 - protein, 113 aa, Artificial Sequence; identical to SEQ ID NO: 438
  Synthetic construct

SEQ ID NO: 1238 - protein, 113 aa, Artificial Sequence; identical to SEQ ID NO: 497
  Synthetic construct

SEQ ID NO: 1239 - protein, 113 aa, Artificial Sequence; identical to SEQ ID NO: 438
  Synthetic construct

SEQ ID NO: 1240 - protein, 113 aa, Artificial Sequence; identical to SEQ ID NO: 499
  Synthetic construct

SEQ ID NO: 1241 - protein, 113 aa, Artificial Sequence; identical to SEQ ID NO: 500
  Synthetic construct

SEQ ID NO: 1242 - protein, 113 aa, Artificial Sequence; identical to SEQ ID NO: 438
  Synthetic construct

SEQ ID NO: 1243 - protein, 108 aa, Artificial Sequence; identical to SEQ ID NO: 447
  Synthetic construct

SEQ ID NO: 1244 - protein, 108 aa, Artificial Sequence; identical to SEQ ID NO: 447
  Synthetic construct

SEQ ID NO: 1245 - protein, 113 aa, Artificial Sequence; identical to SEQ ID NO: 438
  Synthetic construct

SEQ ID NO: 1246 - protein, 113 aa, Artificial Sequence; identical to SEQ ID NO: 438
  Synthetic construct

SEQ ID NO: 1247 - protein, 113 aa, Artificial Sequence; identical to SEQ ID NO: 438
  Synthetic construct

SEQ ID NO: 1248 - protein, 113 aa, Artificial Sequence; identical to SEQ ID NO: 507
  Synthetic construct

SEQ ID NO: 1249 - protein, 108 aa, Artificial Sequence; identical to SEQ ID NO: 447
  Synthetic construct

SEQ ID NO: 1250 - protein, 108 aa, Artificial Sequence; identical to SEQ ID NO: 447
  Synthetic construct

SEQ ID NO: 1251 - protein, 113 aa, Artificial Sequence; identical to SEQ ID NO: 510
  Synthetic construct

SEQ ID NO: 1252 - protein, 113 aa, Artificial Sequence; identical to SEQ ID NO: 511
  Synthetic construct

SEQ ID NO: 1253 - protein, 113 aa, Artificial Sequence; identical to SEQ ID NO: 512
  Synthetic construct

SEQ ID NO: 1254 - protein, 113 aa, Artificial Sequence; identical to SEQ ID NO: 438
  Synthetic construct

SEQ ID NO: 1255 - protein, 113 aa, Artificial Sequence; identical to SEQ ID NO: 438
  Synthetic construct

SEQ ID NO: 1256 - protein, 113 aa, Artificial Sequence; identical to SEQ ID NO: 438
  Synthetic construct

SEQ ID NO: 1257 - protein, 113 aa, Artificial Sequence; identical to SEQ ID NO: 438
  Synthetic construct

SEQ ID NO: 1258 - protein, 113 aa, Artificial Sequence; identical to SEQ ID NO: 438
  Synthetic construct

SEQ ID NO: 1259 - protein, 113 aa, Artificial Sequence; identical to SEQ ID NO: 438
  Synthetic construct

SEQ ID NO: 1260 - protein, 113 aa, Artificial Sequence; identical to SEQ ID NO: 438
  Synthetic construct

SEQ ID NO: 1261 - protein, 113 aa, Artificial Sequence; identical to SEQ ID NO: 520
  Synthetic construct

SEQ ID NO: 1262 - protein, 113 aa, Artificial Sequence; identical to SEQ ID NO: 438
  Synthetic construct

SEQ ID NO: 1263 - protein, 113 aa, Artificial Sequence; identical to SEQ ID NO: 438
  Synthetic construct

SEQ ID NO: 1264 - protein, 113 aa, Artificial Sequence; identical to SEQ ID NO: 438
  Synthetic construct

SEQ ID NO: 1265 - protein, 113 aa, Artificial Sequence; identical to SEQ ID NO: 524
  Synthetic construct

SEQ ID NO: 1266 - protein, 113 aa, Artificial Sequence; identical to SEQ ID NO: 438
  Synthetic construct

SEQ ID NO: 1267 - protein, 113 aa, Artificial Sequence; identical to SEQ ID NO: 438
  Synthetic construct

SEQ ID NO: 1268 - protein, 113 aa, Artificial Sequence; identical to SEQ ID NO: 438
  Synthetic construct

SEQ ID NO: 1269 - protein, 113 aa, Artificial Sequence; identical to SEQ ID NO: 438
  Synthetic construct

SEQ ID NO: 1270 - protein, 113 aa, Artificial Sequence; identical to SEQ ID NO: 438
  Synthetic construct

SEQ ID NO: 1271 - protein, 113 aa, Artificial Sequence; identical to SEQ ID NO: 438
  Synthetic construct

SEQ ID NO: 1272 - protein, 113 aa, Artificial Sequence; identical to SEQ ID NO: 438
  Synthetic construct

SEQ ID NO: 1273 - protein, 113 aa, Artificial Sequence; identical to SEQ ID NO: 532
  Synthetic construct

SEQ ID NO: 1274 - protein, 113 aa, Artificial Sequence; identical to SEQ ID NO: 438
  Synthetic construct

SEQ ID NO: 1275 - protein, 113 aa, Artificial Sequence; identical to SEQ ID NO: 534
  Synthetic construct

SEQ ID NO: 1276 - protein, 113 aa, Artificial Sequence; identical to SEQ ID NO: 438
  Synthetic construct

SEQ ID NO: 1277 - protein, 113 aa, Artificial Sequence; identical to SEQ ID NO: 438
  Synthetic construct

SEQ ID NO: 1278 - protein, 113 aa, Artificial Sequence; identical to SEQ ID NO: 438
  Synthetic construct

SEQ ID NO: 1279 - protein, 113 aa, Artificial Sequence; identical to SEQ ID NO: 438
  Synthetic construct

SEQ ID NO: 1280 - protein, 113 aa, Artificial Sequence; identical to SEQ ID NO: 438
  Synthetic construct

SEQ ID NO: 1281 - protein, 113 aa, Artificial Sequence; identical to SEQ ID NO: 438
  Synthetic construct

SEQ ID NO: 1282 - protein, 113 aa, Artificial Sequence; identical to SEQ ID NO: 438
  Synthetic construct

SEQ ID NO: 1283 - protein, 113 aa, Artificial Sequence; identical to SEQ ID NO: 438
  Synthetic construct

SEQ ID NO: 1284 - protein, 113 aa, Artificial Sequence; identical to SEQ ID NO: 438
  Synthetic construct

SEQ ID NO: 1285 - protein, 113 aa, Artificial Sequence; identical to SEQ ID NO: 471
  Synthetic construct

SEQ ID NO: 1286 - protein, 113 aa, Artificial Sequence; identical to SEQ ID NO: 438
  Synthetic construct

SEQ ID NO: 1287 - protein, 113 aa, Artificial Sequence; identical to SEQ ID NO: 546
  Synthetic construct

SEQ ID NO: 1288 - protein, 113 aa, Artificial Sequence; identical to SEQ ID NO: 547
  Synthetic construct

SEQ ID NO: 1289 - protein, 113 aa, Artificial Sequence; identical to SEQ ID NO: 548
  Synthetic construct

SEQ ID NO: 1290 - protein, 113 aa, Artificial Sequence; identical to SEQ ID NO: 438
  Synthetic construct

SEQ ID NO: 1291 - protein, 113 aa, Artificial Sequence; identical to SEQ ID NO: 550
  Synthetic construct

SEQ ID NO: 1292 - protein, 113 aa, Artificial Sequence; identical to SEQ ID NO: 551
  Synthetic construct

SEQ ID NO: 1293 - protein, 113 aa, Artificial Sequence; identical to SEQ ID NO: 552
  Synthetic construct

SEQ ID NO: 1294 - protein, 113 aa, Artificial Sequence; identical to SEQ ID NO: 438
  Synthetic construct

SEQ ID NO: 1295 - protein, 113 aa, Artificial Sequence; identical to SEQ ID NO: 554
  Synthetic construct

SEQ ID NO: 1296 - protein, 113 aa, Artificial Sequence; identical to SEQ ID NO: 438
  Synthetic construct

SEQ ID NO: 1297 - protein, 113 aa, Artificial Sequence; identical to SEQ ID NO: 556
  Synthetic construct

SEQ ID NO: 1298 - protein, 113 aa, Artificial Sequence; identical to SEQ ID NO: 558
  Synthetic construct

SEQ ID NO: 1299 - protein, 113 aa, Artificial Sequence; identical to SEQ ID NO: 352
  Synthetic construct

SEQ ID NO: 1300 - protein, 113 aa, Artificial Sequence; identical to SEQ ID NO: 353
  Synthetic construct

SEQ ID NO: 1301 - protein, 113 aa, Artificial Sequence; identical to SEQ ID NO: 352
  Synthetic construct

SEQ ID NO: 1302 - protein, 113 aa, Artificial Sequence; identical to SEQ ID NO: 352
  Synthetic construct

SEQ ID NO: 1303 - protein, 113 aa, Artificial Sequence; identical to SEQ ID NO: 352
  Synthetic construct

SEQ ID NO: 1304 - protein, 113 aa, Artificial Sequence; identical to SEQ ID NO: 352
  Synthetic construct

SEQ ID NO: 1305 - protein, 113 aa, Artificial Sequence; identical to SEQ ID NO: 352
  Synthetic construct

SEQ ID NO: 1306 - protein, 113 aa, Artificial Sequence; identical to SEQ ID NO: 352
  Synthetic construct

SEQ ID NO: 1307 - protein, 113 aa, Artificial Sequence; identical to SEQ ID NO: 360
  Synthetic construct

SEQ ID NO: 1308 - protein, 108 aa, Artificial Sequence
  Synthetic construct
EIVLTQSPGTLSLSPGERATLSCRASQSVSTTFLAWYQQKPGQAPRLLIYGTSSRATGIPDRFSGSGSGTDFTLTISSLQAEDVAVYYCQHFYSSPPTFGPGTTVAIK

SEQ ID NO: 1309 - protein, 107 aa, Artificial Sequence
  Synthetic construct
DIQMTQSPSSMSASVGDRVTITCRASQGISSWLAWYQQRPGRAPKLLIYDASRLQSGVPSRFSGSGSGTDFTLTISSLQAEDVAVYYCQHFYSSPPTFGPGTTVAIK

SEQ ID NO: 1310 - protein, 113 aa, Artificial Sequence; identical to SEQ ID NO: 352
  Synthetic construct

SEQ ID NO: 1311 - protein, 58 aa, Artificial Sequence; identical to SEQ ID NO: 362
  Synthetic construct

SEQ ID NO: 1312 - protein, 107 aa, Artificial Sequence
  Synthetic construct
EIMMTQSPATLSVSPGERVILSCRASQSVSSNLAWYQQKPGQAPRLLIYGASTRATGIPARFSGSGSGTDFTLTISSLQAEDVAVYYCQHFYSSPPTFGPGTTVAIK

SEQ ID NO: 1313 - protein, 113 aa, Artificial Sequence; identical to SEQ ID NO: 352
  Synthetic construct

SEQ ID NO: 1314 - protein, 113 aa, Artificial Sequence; identical to SEQ ID NO: 352
  Synthetic construct

SEQ ID NO: 1315 - protein, 113 aa, Artificial Sequence; identical to SEQ ID NO: 352
  Synthetic construct

SEQ ID NO: 1316 - protein, 113 aa, Artificial Sequence; identical to SEQ ID NO: 352
  Synthetic construct

SEQ ID NO: 1317 - protein, 113 aa, Artificial Sequence; identical to SEQ ID NO: 367
  Synthetic construct

SEQ ID NO: 1318 - protein, 113 aa, Artificial Sequence; identical to SEQ ID NO: 352
  Synthetic construct

SEQ ID NO: 1319 - protein, 58 aa, Artificial Sequence; identical to SEQ ID NO: 369
  Synthetic construct

SEQ ID NO: 1320 - protein, 58 aa, Artificial Sequence; identical to SEQ ID NO: 370
  Synthetic construct

SEQ ID NO: 1321 - protein, 113 aa, Artificial Sequence; identical to SEQ ID NO: 371
  Synthetic construct

SEQ ID NO: 1322 - protein, 113 aa, Artificial Sequence; identical to SEQ ID NO: 352
  Synthetic construct

SEQ ID NO: 1323 - protein, 113 aa, Artificial Sequence; identical to SEQ ID NO: 373
  Synthetic construct

SEQ ID NO: 1324 - protein, 113 aa, Artificial Sequence; identical to SEQ ID NO: 352
  Synthetic construct

SEQ ID NO: 1325 - protein, 113 aa, Artificial Sequence; identical to SEQ ID NO: 375
  Synthetic construct

SEQ ID NO: 1326 - protein, 113 aa, Artificial Sequence; identical to SEQ ID NO: 352
  Synthetic construct

SEQ ID NO: 1327 - protein, 113 aa, Artificial Sequence; identical to SEQ ID NO: 352
  Synthetic construct

SEQ ID NO: 1328 - protein, 113 aa, Artificial Sequence; identical to SEQ ID NO: 378
  Synthetic construct

SEQ ID NO: 1329 - protein, 113 aa, Artificial Sequence; identical to SEQ ID NO: 352
  Synthetic construct

SEQ ID NO: 1330 - protein, 113 aa, Artificial Sequence; identical to SEQ ID NO: 352
  Synthetic construct

SEQ ID NO: 1331 - protein, 113 aa, Artificial Sequence; identical to SEQ ID NO: 381
  Synthetic construct

SEQ ID NO: 1332 - protein, 113 aa, Artificial Sequence; identical to SEQ ID NO: 352
  Synthetic construct

SEQ ID NO: 1333 - protein, 110 aa, Artificial Sequence; identical to SEQ ID NO: 383
  Synthetic construct

SEQ ID NO: 1334 - protein, 58 aa, Artificial Sequence; identical to SEQ ID NO: 384
  Synthetic construct

SEQ ID NO: 1335 - protein, 113 aa, Artificial Sequence; identical to SEQ ID NO: 352
  Synthetic construct

SEQ ID NO: 1336 - protein, 113 aa, Artificial Sequence; identical to SEQ ID NO: 352
  Synthetic construct

SEQ ID NO: 1337 - protein, 113 aa, Artificial Sequence; identical to SEQ ID NO: 352
  Synthetic construct

SEQ ID NO: 1338 - protein, 58 aa, Artificial Sequence; identical to SEQ ID NO: 370
  Synthetic construct

SEQ ID NO: 1339 - protein, 113 aa, Artificial Sequence; identical to SEQ ID NO: 352
  Synthetic construct

SEQ ID NO: 1340 - protein, 113 aa, Artificial Sequence; identical to SEQ ID NO: 352
  Synthetic construct

SEQ ID NO: 1341 - protein, 113 aa, Artificial Sequence; identical to SEQ ID NO: 352
  Synthetic construct

SEQ ID NO: 1342 - protein, 113 aa, Artificial Sequence; identical to SEQ ID NO: 392
  Synthetic construct

SEQ ID NO: 1343 - protein, 75 aa, Artificial Sequence; identical to SEQ ID NO: 393
  Synthetic construct

SEQ ID NO: 1344 - protein, 113 aa, Artificial Sequence; identical to SEQ ID NO: 352
  Synthetic construct

SEQ ID NO: 1345 - protein, 113 aa, Artificial Sequence; identical to SEQ ID NO: 352
  Synthetic construct

SEQ ID NO: 1346 - protein, 113 aa, Artificial Sequence; identical to SEQ ID NO: 352
  Synthetic construct

SEQ ID NO: 1347 - protein, 113 aa, Artificial Sequence; identical to SEQ ID NO: 352
  Synthetic construct

SEQ ID NO: 1348 - protein, 113 aa, Artificial Sequence; identical to SEQ ID NO: 352
  Synthetic construct

SEQ ID NO: 1349 - protein, 113 aa, Artificial Sequence; identical to SEQ ID NO: 352
  Synthetic construct

SEQ ID NO: 1350 - protein, 58 aa, Artificial Sequence; identical to SEQ ID NO: 370
  Synthetic construct

SEQ ID NO: 1351 - protein, 113 aa, Artificial Sequence; identical to SEQ ID NO: 401
  Synthetic construct

SEQ ID NO: 1352 - protein, 75 aa, Artificial Sequence; identical to SEQ ID NO: 393
  Synthetic construct

SEQ ID NO: 1353 - protein, 113 aa, Artificial Sequence; identical to SEQ ID NO: 352
  Synthetic construct

SEQ ID NO: 1354 - protein, 113 aa, Artificial Sequence; identical to SEQ ID NO: 352
  Synthetic construct

SEQ ID NO: 1355 - protein, 113 aa, Artificial Sequence; identical to SEQ ID NO: 352
  Synthetic construct

SEQ ID NO: 1356 - protein, 113 aa, Artificial Sequence; identical to SEQ ID NO: 352
  Synthetic construct

SEQ ID NO: 1357 - protein, 113 aa, Artificial Sequence; identical to SEQ ID NO: 352
  Synthetic construct

SEQ ID NO: 1358 - protein, 113 aa, Artificial Sequence; identical to SEQ ID NO: 352
  Synthetic construct

SEQ ID NO: 1359 - protein, 58 aa, Artificial Sequence; identical to SEQ ID NO: 370
  Synthetic construct

SEQ ID NO: 1360 - protein, 113 aa, Artificial Sequence; identical to SEQ ID NO: 352
  Synthetic construct

SEQ ID NO: 1361 - protein, 110 aa, Artificial Sequence; identical to SEQ ID NO: 411
  Synthetic construct

SEQ ID NO: 1362 - protein, 113 aa, Artificial Sequence; identical to SEQ ID NO: 352
  Synthetic construct

SEQ ID NO: 1363 - protein, 113 aa, Artificial Sequence; identical to SEQ ID NO: 413
  Synthetic construct

SEQ ID NO: 1364 - protein, 113 aa, Artificial Sequence; identical to SEQ ID NO: 414
  Synthetic construct

SEQ ID NO: 1365 - protein, 113 aa, Artificial Sequence; identical to SEQ ID NO: 352
  Synthetic construct

SEQ ID NO: 1366 - protein, 113 aa, Artificial Sequence; identical to SEQ ID NO: 352
  Synthetic construct

SEQ ID NO: 1367 - protein, 58 aa, Artificial Sequence; identical to SEQ ID NO: 370
  Synthetic construct

SEQ ID NO: 1368 - protein, 107 aa, Artificial Sequence
  Synthetic construct
EIVLTQSPATLSLSPGERATLSCRASQSVSRYLAWYQQKPGQAPRLLIYDASNRATGIPARFSGSGSGTDFTLTISSLQAEDVAVYYCQHFYSSPPTFGPGTTVAIK

SEQ ID NO: 1369 - protein, 113 aa, Artificial Sequence; identical to SEQ ID NO: 418
  Synthetic construct

SEQ ID NO: 1370 - protein, 113 aa, Artificial Sequence; identical to SEQ ID NO: 352
  Synthetic construct

SEQ ID NO: 1371 - protein, 113 aa, Artificial Sequence; identical to SEQ ID NO: 352
  Synthetic construct

SEQ ID NO: 1372 - protein, 58 aa, Artificial Sequence; identical to SEQ ID NO: 370
  Synthetic construct

SEQ ID NO: 1373 - protein, 113 aa, Artificial Sequence; identical to SEQ ID NO: 352
  Synthetic construct

SEQ ID NO: 1374 - protein, 113 aa, Artificial Sequence; identical to SEQ ID NO: 423
  Synthetic construct

SEQ ID NO: 1375 - protein, 113 aa, Artificial Sequence; identical to SEQ ID NO: 424
  Synthetic construct

SEQ ID NO: 1376 - protein, 113 aa, Artificial Sequence; identical to SEQ ID NO: 352
  Synthetic construct

SEQ ID NO: 1377 - protein, 113 aa, Artificial Sequence; identical to SEQ ID NO: 352
  Synthetic construct

SEQ ID NO: 1378 - protein, 75 aa, Artificial Sequence; identical to SEQ ID NO: 393
  Synthetic construct

SEQ ID NO: 1379 - protein, 113 aa, Artificial Sequence; identical to SEQ ID NO: 352
  Synthetic construct

SEQ ID NO: 1380 - protein, 113 aa, Artificial Sequence; identical to SEQ ID NO: 429
  Synthetic construct

SEQ ID NO: 1381 - protein, 113 aa, Artificial Sequence; identical to SEQ ID NO: 430
  Synthetic construct

SEQ ID NO: 1382 - protein, 113 aa, Artificial Sequence; identical to SEQ ID NO: 352
  Synthetic construct

SEQ ID NO: 1383 - protein, 58 aa, Artificial Sequence; identical to SEQ ID NO: 370
  Synthetic construct

SEQ ID NO: 1384 - protein, 113 aa, Artificial Sequence; identical to SEQ ID NO: 559
  Synthetic construct

SEQ ID NO: 1385 - protein, 113 aa, Artificial Sequence; identical to SEQ ID NO: 560
  Synthetic construct

SEQ ID NO: 1386 - protein, 113 aa, Artificial Sequence; identical to SEQ ID NO: 561
  Synthetic construct

SEQ ID NO: 1387 - protein, 113 aa, Artificial Sequence; identical to SEQ ID NO: 559
  Synthetic construct

SEQ ID NO: 1388 - protein, 108 aa, Artificial Sequence; identical to SEQ ID NO: 563
  Synthetic construct

SEQ ID NO: 1389 - protein, 113 aa, Artificial Sequence; identical to SEQ ID NO: 564
  Synthetic construct

SEQ ID NO: 1390 - protein, 113 aa, Artificial Sequence; identical to SEQ ID NO: 565
  Synthetic construct

SEQ ID NO: 1391 - protein, 113 aa, Artificial Sequence; identical to SEQ ID NO: 559
  Synthetic construct

SEQ ID NO: 1392 - protein, 113 aa, Artificial Sequence; identical to SEQ ID NO: 559
  Synthetic construct

SEQ ID NO: 1393 - protein, 113 aa, Artificial Sequence; identical to SEQ ID NO: 559
  Synthetic construct

SEQ ID NO: 1394 - protein, 113 aa, Artificial Sequence; identical to SEQ ID NO: 559
  Synthetic construct

SEQ ID NO: 1395 - protein, 113 aa, Artificial Sequence; identical to SEQ ID NO: 570
  Synthetic construct

SEQ ID NO: 1396 - protein, 113 aa, Artificial Sequence; identical to SEQ ID NO: 571
  Synthetic construct

SEQ ID NO: 1397 - protein, 113 aa, Artificial Sequence; identical to SEQ ID NO: 559
  Synthetic construct

SEQ ID NO: 1398 - protein, 113 aa, Artificial Sequence; identical to SEQ ID NO: 559
  Synthetic construct

SEQ ID NO: 1399 - protein, 109 aa, Artificial Sequence
  Synthetic construct
QSALTQPRSVSGSPGQSVTISCTGTSTYVDAFTYVSWYQQHPGRAPKVLIYDVNKRPSGVPDRFSGSKSGSTTSLTISDLHIEDEADYYCCLYAGSYSWVFGGGTKLTV

SEQ ID NO: 1400 - protein, 109 aa, Artificial Sequence
  Synthetic construct
QSALTQPRSVSGSTGQSVTISCTGTSSDVGGYNYVSWYQHLPGKAPKLIIYDVSERPSGFPDRSSGSKSGNTASLTISGLQAEDEANYYYCSYAGSYNWVFGGGTKVTV

SEQ ID NO: 1401 - protein, 110 aa, Artificial Sequence
  Synthetic construct
QSALTQPRSVSGSTGQSVTISCTGTRSDVGGYNYVSWYQHLPGKAPKLIIYDVSERPSGFPDRFSGSKSGNTASLTISGLQAEDEANYYCCSYAGRYNWVFGGGTKVTVL

SEQ ID NO: 1402 - protein, 110 aa, Artificial Sequence
  Synthetic construct
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYWAVFGGGTKLTVL

SEQ ID NO: 1403 - protein, 110 aa, Artificial Sequence
  Synthetic construct
QSALTQPRSVSWSPGQSVTISCTGTSSDVGGYNYVSWYQQHPGKAPKLMIYDVSKRPSGVPDRFSGSKSGNTASLTISGLQAEDEADYYCCSYAGSYWAVFGGGTKLTVL

SEQ ID NO: 1404 - protein, 110 aa, Artificial Sequence
  Synthetic construct
QSALTQPRSVSGSPGYSVTISCTGTSSDVGAYNYVSWYQQHPGEAPQLKIYDVSKRPSGVPDRFSGSRSGNTASLTISGLQAEDEADYFCCPYAGSYTWVFGGGTRLTVL

SEQ ID NO: 1405 - protein, 110 aa, Artificial Sequence
  Synthetic construct
QSALTQPRSVSGSPGQSVTISCTGTSSDVGGYNYVSWYQQHPGKAPKLMIYDVSKRPSGVPDRFSGSKSGNTASLTISGLQAEDEADYYCCTYAGSYTWVFGGGTKLTVL

SEQ ID NO: 1406 - protein, 108 aa, Artificial Sequence
  Synthetic construct
SYVLTQPPSVSVAPGQTARITCGGDYFEVKSVHWYQQKPGQAPVLVAFDDTDRPSGIPDRFSGSTSGNTATLTISRVEVGDEADYYCQVWDSSSEHVVFGGGSKLTVL

SEQ ID NO: 1407 - protein, 108 aa, Artificial Sequence
  Synthetic construct
SYVLTQPPSVSVAPGQTARITCGGNNIGSKSVHWYQQKPGQAPVLVVYADSDRPSGIPERFSGSNSGNTATLTISRVEAGDEADYYCQMWDSSSEHVVFGGGTKLTVL

SEQ ID NO: 1408 - protein, 81 aa, Artificial Sequence
  Synthetic construct
IGIRSVHWYRQKSRLAPTLVVYDDTERPSGIPERVSGSTSGDTATLTISRVEVGDEADYYCQAWDSSSDHVVYGGGTKLTV

SEQ ID NO: 1409 - protein, 107 aa, Artificial Sequence
  Synthetic construct
SYVLAQPPSVSVAPGRTAWITCGGNSIGSKSVHWYQQKPGQAPVLVVYDNNDRPSGIPERFSGSNSGNTATLTIYRVEVGDEADYYCQAWYSSSDHVVFGGGTKLTV

SEQ ID NO: 1410 - protein, 60 aa, Artificial Sequence
  Synthetic construct
DDSDRPSGIPERFSGSNSGNTATLTISRVEAGDEADYYCQMWDSSSDHVVFGGGTKLTVL

SEQ ID NO: 1411 - protein, 77 aa, Artificial Sequence
  Synthetic construct
VHWYQQEPGQAPMLVVYDDSDRPSGIPERFSGSNSGNTATLTISRVEAGDEADYYCQMWDSSSDHVVFGGGTKLTVL

SEQ ID NO: 1412 - protein, 57 aa, Artificial Sequence
  Synthetic construct
DRPSGIPERFSGSNSGNTATLTISRVEAGDEADYYCQMWDSSSDHVVFGGGTKLTVL

SEQ ID NO: 1413 - protein, 22 aa, Artificial Sequence
  Synthetic construct
CQMWDSSSDHVVFGGGTKLTVL

SEQ ID NO: 1414 - protein, 83 aa, Artificial Sequence
  Synthetic construct
NIGSKSVNWYQQKPGQAPVLVVSDDSDRPSGIPERFSGSNSGNTATLTISRVEAGDEADYYCQMWDSSSDHVVFGGGTKVTVL

SEQ ID NO: 1415 - protein, 77 aa, Artificial Sequence
  Synthetic construct
VHWYQQEPGQAPVLVVYDDSDRPSGIPERFSGSNSGNTATLTISRVEAGDEADYYCQMWDSSSDHVVFGGGTKLTVL

SEQ ID NO: 1416 - protein, 108 aa, Artificial Sequence
  Synthetic construct
SYVLTQPPSMSVAPGQTARITCGGNNIGSKSVHWYQQEPGQAPVLVVYDDSDRPSGIPERFSGSNSGNTATLTISRVEAGDEADYYCQMWDSSSDHVVFGGGTKLTVL

SEQ ID NO: 1417 - protein, 60 aa, Artificial Sequence; identical to SEQ ID NO: 1410
  Synthetic construct

SEQ ID NO: 1418 - protein, 57 aa, Artificial Sequence; identical to SEQ ID NO: 1412
  Synthetic construct

SEQ ID NO: 1419 - protein, 108 aa, Artificial Sequence
  Synthetic construct
SYVLTQPPSMSVAPGQTARITCGGNNIGTKSVHWYQQEPGQAPVLVVYDDGDRPSGIPERFSGSNSGNTATLTISRVEAGDEADYYCQMWDSSSDHVVFGGGTKLTVL

SEQ ID NO: 1420 - protein, 83 aa, Artificial Sequence
  Synthetic construct
KIRSKSVHWYQQRPGRAPVAVVFDDSGRPSGIPERFSGSNSGNTATLTISWVEAGDEADYYCQMWDSSSDHVVFGGGTKLTVL

SEQ ID NO: 1421 - protein, 22 aa, Artificial Sequence
  Synthetic construct
CQMWDSSSDHVVFGGGTKLTVL

SEQ ID NO: 1422 - protein, 60 aa, Artificial Sequence; identical to SEQ ID NO: 1410
  Synthetic construct

SEQ ID NO: 1423 - protein, 108 aa, Artificial Sequence
  Synthetic construct
SYVLTQPPSVSVAPGHTARITCGGNNIGSKSVHWYQQEPGQAPVLVVYDDSDRPSGIPERFSGSNSGNTATLTISGVEAGDEADYYCQMWDSSSDHVVFGGGTKLTVL

SEQ ID NO: 1424 - protein, 60 aa, Artificial Sequence; identical to SEQ ID NO: 1410
  Synthetic construct

SEQ ID NO: 1425 - protein, 22 aa, Artificial Sequence
  Synthetic construct
CQMWDSSSDHVVFGGGTKLTVL

SEQ ID NO: 1426 - protein, 22 aa, Artificial Sequence
  Synthetic construct
CQMWDSSSDHVVFGGGTKLTVL

SEQ ID NO: 1427 - protein, 108 aa, Artificial Sequence
  Synthetic construct
SYVLTQPPSMSVAPGQPARITCGGNNIGSKSVHWYQQEPGQAPVLVVYDDSDRPSGIPERFSGSNSGNTATLTISGVEAGDEADYYCQMWDSSSDHVVFGGGTKLTVL

SEQ ID NO: 1428 - protein, 60 aa, Artificial Sequence; identical to SEQ ID NO: 1410
  Synthetic construct

SEQ ID NO: 1429 - protein, 22 aa, Artificial Sequence
  Synthetic construct
CQMWDSSSDHVVFGGGTKLTVL

SEQ ID NO: 1430 - protein, 83 aa, Artificial Sequence; identical to SEQ ID NO: 1414
  Synthetic construct

SEQ ID NO: 1431 - protein, 83 aa, Artificial Sequence
  Synthetic construct
NIGSKSVHWYQQEPGQAPVLVVYDDSDRPSGIPERFSGSNSGNTATLTISRVEAGDEADYYCQMWDSSSDHVVFGGGTKLTVL

SEQ ID NO: 1432 - protein, 83 aa, Artificial Sequence; identical to SEQ ID NO: 1414
  Synthetic construct

SEQ ID NO: 1433 - protein, 22 aa, Artificial Sequence
  Synthetic construct
CQMWDSSSDHVVFGGGTKLTVL

SEQ ID NO: 1434 - protein, 60 aa, Artificial Sequence; identical to SEQ ID NO: 1410
  Synthetic construct

SEQ ID NO: 1435 - protein, 60 aa, Artificial Sequence; identical to SEQ ID NO: 1410
  Synthetic construct

SEQ ID NO: 1436 - protein, 60 aa, Artificial Sequence; identical to SEQ ID NO: 1410
  Synthetic construct

SEQ ID NO: 1437 - protein, 108 aa, Artificial Sequence
  Synthetic construct
SYVLTQPPSVSVAPGQTARITCGGNNIGSKSVHWYQQKPGQAPVLVVYDDSDRPSGIPERFSGSNSGNTATLTISRVEAGDEADYYCQMWDSSSDHVVFGGGTKLTVL

SEQ ID NO: 1438 - protein, 22 aa, Artificial Sequence
  Synthetic construct
CQMWDSSSDHVVFGGGTKLTVL

SEQ ID NO: 1439 - protein, 108 aa, Artificial Sequence; identical to SEQ ID NO: 1416
  Synthetic construct

SEQ ID NO: 1440 - protein, 81 aa, Artificial Sequence
  Synthetic construct
IGIRSVHWYRQKSRLAPTLVVYDDTERPSGIPERVSGSTSGDTATLTISRVEVGDEADYYCQAWDSSSDHVVFGGGTKLTV

SEQ ID NO: 1441 - protein, 107 aa, Artificial Sequence
  Synthetic construct
SYILTQPPSVSVAPGQTATITCGGYNIRSKSVHWYQQRPGQAPVAVVYDDSGRPSGIPARFSGSNSGNTATLTISRVEAGDEADYYCQAWDSSSDHVVFGGGTKLTV

SEQ ID NO: 1442 - protein, 81 aa, Artificial Sequence; identical to SEQ ID NO: 1440
  Synthetic construct

SEQ ID NO: 1443 - protein, 81 aa, Artificial Sequence; identical to SEQ ID NO: 1440
  Synthetic construct

SEQ ID NO: 1444 - protein, 81 aa, Artificial Sequence; identical to SEQ ID NO: 1440
  Synthetic construct

SEQ ID NO: 1445 - protein, 81 aa, Artificial Sequence; identical to SEQ ID NO: 1440
  Synthetic construct

SEQ ID NO: 1446 - protein, 81 aa, Artificial Sequence; identical to SEQ ID NO: 1440
  Synthetic construct

SEQ ID NO: 1447 - protein, 81 aa, Artificial Sequence; identical to SEQ ID NO: 1440
  Synthetic construct

SEQ ID NO: 1448 - protein, 81 aa, Artificial Sequence; identical to SEQ ID NO: 1440
  Synthetic construct

SEQ ID NO: 1449 - protein, 81 aa, Artificial Sequence; identical to SEQ ID NO: 1440
  Synthetic construct

SEQ ID NO: 1450 - protein, 108 aa, Artificial Sequence
  Synthetic construct
SYVLTQPPSVSVAPGQTARITCGGNNIGSISVHWYQQRPGQAPVLVVYDDSDRPSGVPGRFSGANSGNTATLSISRVEAGDEADYYCQAWDSSSDHVVFGGGTKLTVL

SEQ ID NO: 1451 - protein, 81 aa, Artificial Sequence; identical to SEQ ID NO: 1440
  Synthetic construct

SEQ ID NO: 1452 - protein, 81 aa, Artificial Sequence; identical to SEQ ID NO: 1440
  Synthetic construct

SEQ ID NO: 1453 - protein, 81 aa, Artificial Sequence
  Synthetic construct
IGIRSVHWYRQKSRLAPTLVVYDDTERPSGIPERVSGSTSEDTATLTISRVEFGDEADYYCQAWDSSSDHVVFGGGTKLTV

SEQ ID NO: 1454 - protein, 81 aa, Artificial Sequence; identical to SEQ ID NO: 1440
  Synthetic construct

SEQ ID NO: 1455 - protein, 81 aa, Artificial Sequence
  Synthetic construct
IGIRSVHWYRQKSRLAPTLVVYDDTERPSGIPERVPGSTSGDTATLTISRVEVGDEADYYCQAWDSSSDHVVFGGGTKLTV

SEQ ID NO: 1456 - protein, 81 aa, Artificial Sequence
  Synthetic construct
IGIRSVHWYRQKARLAPTLVVYDDTARPSGIPERVSGSTSGDTATLTISRVEVGDEADYYCQAWDSSSDHVVFGGGTKLTV

SEQ ID NO: 1457 - protein, 81 aa, Artificial Sequence; identical to SEQ ID NO: 1440
  Synthetic construct

SEQ ID NO: 1458 - protein, 81 aa, Artificial Sequence; identical to SEQ ID NO: 1440
  Synthetic construct

SEQ ID NO: 1459 - protein, 81 aa, Artificial Sequence; identical to SEQ ID NO: 1440
  Synthetic construct

SEQ ID NO: 1460 - protein, 81 aa, Artificial Sequence; identical to SEQ ID NO: 1440
  Synthetic construct

SEQ ID NO: 1461 - protein, 81 aa, Artificial Sequence; identical to SEQ ID NO: 1440
  Synthetic construct

SEQ ID NO: 1462 - protein, 81 aa, Artificial Sequence; identical to SEQ ID NO: 1440
  Synthetic construct

SEQ ID NO: 1463 - protein, 83 aa, Artificial Sequence
  Synthetic construct
NIGSKSVHWYQQKPGQAPVLVVYDDSDRPSGIPERFSGSNSGNTATLTISRVEAGDEADYYCQAWDSSSDHVVFGGGTKLTVL

SEQ ID NO: 1464 - protein, 81 aa, Artificial Sequence; identical to SEQ ID NO: 1440
  Synthetic construct

SEQ ID NO: 1465 - protein, 81 aa, Artificial Sequence; identical to SEQ ID NO: 1440
  Synthetic construct

SEQ ID NO: 1466 - protein, 81 aa, Artificial Sequence; identical to SEQ ID NO: 1440
  Synthetic construct

SEQ ID NO: 1467 - protein, 108 aa, Artificial Sequence
  Synthetic construct
SYVLTQPPSVSVAPGQTARIACGGNSIGSKGVHWYQQKPGQAPALVVYDDSDRPSGIPERFSGSNSGNTATLTISRVEVGDEADYYCQVWDSSSEHVVFGGGTKLTVL

SEQ ID NO: 1468 - protein, 108 aa, Artificial Sequence
  Synthetic construct
SYVLTQPPSVSVAPGKTARISCGGDYFEIKSVHWYQQKPGQAPVLVVFDDTDRPSGIPARFSGSNSGNTATLTISRVEVGDEADYYCQVWDSSSEHVVFGGGSKLTVL

SEQ ID NO: 1469 - protein, 60 aa, Artificial Sequence
  Synthetic construct
DDSDRPSGIPERFSGSNSGNTATLTISRVEVGDEADYYCQVWDSSSEHVVFGGGSKLTVL

SEQ ID NO: 1470 - protein, 108 aa, Artificial Sequence
  Synthetic construct
SYVLTQPPSVSVAPGKTARITCGGDYFEVKSVHWYQQKPGQAPVLVVFGDTDRPSGIPERFSGSNSGNTATLTISRVEVGDEADYYCQVWDSSSEHVVFGGGSKLTVL

SEQ ID NO: 1471 - protein, 108 aa, Artificial Sequence
  Synthetic construct
SYVLTQPPSVSVAPGQTARITSGGNNIGSISVHWYQQRPGQAPVLVVYDDSDRPSGIPERFSGSNSGNTATLSISRVEAGDEADYYCQVWDSSSEHVVFGGGTKLTVL

SEQ ID NO: 1472 - protein, 108 aa, Artificial Sequence
  Synthetic construct
SYVLTQSPSVSEAPGKTARITCGGSYIGSKSVHWYQQKPGQAPVLVVYDDSDRPSGIPDRFSGSNSGNTATLTISRVEAGDEADYYCQVWDSSSEHVVFGGGTKLTVL

SEQ ID NO: 1473 - protein, 108 aa, Artificial Sequence
  Synthetic construct
SYVLTQPPSVSVAPGKTARITCGGDYFEVKSVHWYQQKPGQAPVLVVFDDTDRPSGIPERFSGSNSGNTATLTISRVEVGDEADYYCQVWDSSSEHVVFGGGSKLTVL

SEQ ID NO: 1474 - protein, 108 aa, Artificial Sequence
  Synthetic construct
SYVLTQPPSVSVAPGKTARISCGGDYFGIKSVHWYQQKPGQAPVLVVFDDTDRPSGIPERFSGSNSGNTATLTISRVEVGDEADYYCQVWDSSSEHVVFGGGSKLTVL

SEQ ID NO: 1475 - protein, 108 aa, Artificial Sequence; identical to SEQ ID NO: 1474
  Synthetic construct

SEQ ID NO: 1476 - protein, 108 aa, Artificial Sequence
  Synthetic construct
SYVLTQPPSVTVAPGKTATITCGGSYFDIKSVHWYQQKPGQAPVLVVFDDTDRPSGIPERFSGSNSGNTATLTISRVEVGDEADYYCQVWDSSSEHVVFGGGSKLTVL

SEQ ID NO: 1477 - protein, 108 aa, Artificial Sequence
  Synthetic construct
SYVLTQPPSVSVAPGKTARISCGGDYFEIKSVHWYQQKPGQAPVLVVFDDTDRPSGIPERFSGSNSGNTATLTISRVEVGDEADYYCQVWDSSSEHVVFGGGSKLTVL

SEQ ID NO: 1478 - protein, 60 aa, Artificial Sequence; identical to SEQ ID NO: 1469
  Synthetic construct

SEQ ID NO: 1479 - protein, 108 aa, Artificial Sequence
  Synthetic construct
SYVLTQPPSVSVAPGKTARISCGGVYFGIKSVHWYQQKPGQAPVLVVFDDTDRPSGIPERFSGSNSGNTATLTISRVEVGDEADYYCQVWDSSSEHVVFGGGSKLTVL

SEQ ID NO: 1480 - protein, 108 aa, Artificial Sequence
  Synthetic construct
SYVLTQPPSVTVAPGKTATITCGGSYFDIKSVHWYQQKPGQAPVLVVFDDTDRPSGIPERFSGSNSGNTATLTISRVEVGDEANYYCQVWDSSSEHVVFGGGSKLTVL

SEQ ID NO: 1481 - protein, 108 aa, Artificial Sequence
  Synthetic construct
SYVLTQPPSVSVAPGKTARITCGGDYFEVKSVHWYQQKPGQAPVVVVFDDTDRPSGIPERFSGSNSGNTATLTISRVEVGDEADYYCQVWDSSSEHVVFGGGTKLTVL

SEQ ID NO: 1482 - protein, 108 aa, Artificial Sequence
  Synthetic construct
SYVLTQPPSVSVAPGKTARITCGGDYFEVKSVHWYQQKPGQAPVVVVFDDTDRPSGIPERFSGSNSGNTATLTISRVEVGDEADYYCQVWDSSSEHVVFGGGTKVTVL

SEQ ID NO: 1483 - protein, 22 aa, Artificial Sequence
  Synthetic construct
CQVWDSSSEHVVFGGWTKLTVL

SEQ ID NO: 1484 - protein, 108 aa, Artificial Sequence; identical to SEQ ID NO: 1481
  Synthetic construct

SEQ ID NO: 1485 - protein, 108 aa, Artificial Sequence
  Synthetic construct
SYVLTQPPSVSVAPGKTARITCGGDYFEVKSVHWYQQKPGQAPVVVVFDDTDRPSGIPERFSGSNSGNTATLTITRVEVGDEADYYCQVWDSSSEHVVFGGGTKLTVL

SEQ ID NO: 1486 - protein, 108 aa, Artificial Sequence
  Synthetic construct
SYVLTQPPSVSVAPGKTARITCGGDYFEVKSVHWYQQKPGQAPVLVVFDDTDRPSGIPERFSGPNSGNTATLTISRGEVGDEADYYCQVWDSSSEHVVFGGGSKLTVL

SEQ ID NO: 1487 - protein, 108 aa, Artificial Sequence; identical to SEQ ID NO: 1481
  Synthetic construct

SEQ ID NO: 1488 - protein, 108 aa, Artificial Sequence; identical to SEQ ID NO: 1474
  Synthetic construct

SEQ ID NO: 1489 - protein, 108 aa, Artificial Sequence; identical to SEQ ID NO: 1474
  Synthetic construct

SEQ ID NO: 1490 - protein, 108 aa, Artificial Sequence
  Synthetic construct
SYVLTQPPSVTVAPGKTATITCGGSYFDIKSVHWYQQKPGQAPVLVVFDDTDRPSGSPERFSGSNSGNTATLTISRVEVGDEADYYCQVWDSSSEHVVFGGGSKLTVL

SEQ ID NO: 1491 - protein, 108 aa, Artificial Sequence; identical to SEQ ID NO: 1474
  Synthetic construct

SEQ ID NO: 1492 - protein, 82 aa, Artificial Sequence
  Synthetic construct
FGIKSVHWYQQKPGQAPVLVVFDDTDRPSGIPERFSGSNSGNTATLTISRVEVGDEADYYCQVWDSSSEHVVFGGGSKLTVL

SEQ ID NO: 1493 - protein, 83 aa, Artificial Sequence
  Synthetic construct
KIRSKSVHWYQQRPGRAPVAVVFDDSGRPSGIPERFSGSNSGNTATLTISWVEAGDEADYYCQVWDSSSEHVVFGGGTKLTVL

SEQ ID NO: 1494 - protein, 108 aa, Artificial Sequence; identical to SEQ ID NO: 1481
  Synthetic construct

SEQ ID NO: 1495 - protein, 108 aa, Artificial Sequence
  Synthetic construct
SYVLTQPPSVSVAPGKTARITCGGDYFEVKSVHWYQQKPGQAPVVVVFDDTDRPSGIPERFSGSNSGNTATLTISRVEIGDEADYYCQVWDSSSEHVVFGGGTKLTVL

SEQ ID NO: 1496 - protein, 60 aa, Artificial Sequence; identical to SEQ ID NO: 1469
  Synthetic construct

SEQ ID NO: 1497 - protein, 107 aa, Artificial Sequence
  Synthetic construct
SYVVTQPPSVSVAPGKTARITCGGNNIGNKAVHWYQQRPGQAPVLVIYDDSDRRSGIPERFSGSNSGHTATLTISGVEGGDEADYYCQVWDSSSEHVVFGGGTKLTV

SEQ ID NO: 1498 - protein, 108 aa, Artificial Sequence
  Synthetic construct
SYVLTQPPSVSVAPGKTARITCGGDYFEVKSVHWYQQKPGQAPVVVVFDDTDRPSGIPERFSGANAGNTATLTISRVEVGDEADYYCQVWDSSSEHVVFGGGTKLTVL

SEQ ID NO: 1499 - protein, 108 aa, Artificial Sequence
  Synthetic construct
SYVLTQPPSVSVAPGKTARISCGGDYFGIKSVHWYQQKPGQAPVLVVFDDTDRPSGIPERVSGSNSGNTATLTISRVEVGDEADYYCQVWDSSSEHVVFGGGSKLTVL

SEQ ID NO: 1500 - protein, 108 aa, Artificial Sequence
  Synthetic construct
SYVLTQPPSLSVAPGKTARITCGGDYFEVKSIHWYQQKPGQAPVVVVFDDTDRPSGIPERFSGSNSGNTATLTISRVEVGDEADYYCQVWDSSSEHVVFGGGTKLTVL

SEQ ID NO: 1501 - protein, 108 aa, Artificial Sequence; identical to SEQ ID NO: 1474
  Synthetic construct

SEQ ID NO: 1502 - protein, 108 aa, Artificial Sequence; identical to SEQ ID NO: 1477
  Synthetic construct

SEQ ID NO: 1503 - protein, 108 aa, Artificial Sequence; identical to SEQ ID NO: 1476
  Synthetic construct

SEQ ID NO: 1504 - protein, 108 aa, Artificial Sequence; identical to SEQ ID NO: 1481
  Synthetic construct

SEQ ID NO: 1505 - protein, 108 aa, Artificial Sequence; identical to SEQ ID NO: 1476
  Synthetic construct

SEQ ID NO: 1506 - protein, 108 aa, Artificial Sequence; identical to SEQ ID NO: 1477
  Synthetic construct

SEQ ID NO: 1507 - protein, 22 aa, Artificial Sequence
  Synthetic construct
CQVWDSSSEHVVFGGGSKLTVL

SEQ ID NO: 1508 - protein, 60 aa, Artificial Sequence
  Synthetic construct
DDTDRPSGIPERFSGSNSGNTATLTISRVEVGDEADYYCQVWDSSSEHVVFGGGSKLTVL

SEQ ID NO: 1509 - protein, 108 aa, Artificial Sequence
  Synthetic construct
SYVLTQPPSVTVAPGKTATITCGGNYFEIKSVHWYQQKPGQAPVLVVYDDSDRPSGIPERFSGSNSGNTATLTISRVEVGDEADYYCQVWDSSSEHVVFGGGSKLTVL

SEQ ID NO: 1510 - protein, 22 aa, Artificial Sequence
  Synthetic construct
CQVWDSSSEHVVFGGGTKLTVL

SEQ ID NO: 1511 - protein, 108 aa, Artificial Sequence; identical to SEQ ID NO: 1481
  Synthetic construct

SEQ ID NO: 1512 - protein, 108 aa, Artificial Sequence
  Synthetic construct
SSVLTQPPSVSVAPGQTARITCGGSNIGTHSVHWYQQKPGQAPVLVVYDSSHRPSGIPERFSGSNSGNTATLTISRVEAGDEADYYCQVWDSSSEHVVFGGGTKLTVL

SEQ ID NO: 1513 - protein, 108 aa, Artificial Sequence
  Synthetic construct
SYVLTQPPSVSVAPGKTARISCGGVYFEIKSVHWYQQKPGQAPVLVVFDDTDRPSGIPERFSGSNSGNTATLTISRVEVGDEADYYCQVWDSSSEHVVFGGGSKLTVL

SEQ ID NO: 1514 - protein, 22 aa, Artificial Sequence
  Synthetic construct
CQVWDSSSEHVVFGGGSKLTVL

SEQ ID NO: 1515 - protein, 108 aa, Artificial Sequence; identical to SEQ ID NO: 1474
  Synthetic construct

SEQ ID NO: 1516 - protein, 22 aa, Artificial Sequence
  Synthetic construct
CQVWDSSSEHVVFGGGSKLTVL

SEQ ID NO: 1517 - protein, 108 aa, Artificial Sequence
  Synthetic construct
SYGLTQPPSVTVAPGKTATITCGGSYFDIKSVHWYQQKPGQAPVLVVFDDTDRPSGIPERFSGSNSGNTATLTISRVEVGDEADYYCQVWDSSSEHVVFGGGSKLTVL

SEQ ID NO: 1518 - protein, 107 aa, Artificial Sequence
  Synthetic construct
SYVVTQPPSVSVAPGKTARINCGGNKIGNKAVHWYQQRPGQAPVLVIYDDSDRRSGIPERFSGSNSGHTATLTISGVEGGDEADYYCQVWDSSSEHVVFGGGTKLTV

SEQ ID NO: 1519 - protein, 108 aa, Artificial Sequence; identical to SEQ ID NO: 1474
  Synthetic construct

SEQ ID NO: 1520 - protein, 82 aa, Artificial Sequence
  Synthetic construct
FDIKSVHWYQQKPGQAPVLVVFDDTDRPSGIPERFSGSNSGNTATLTISRVEVGDEADYYCQVWDSSSEHVVFGGGSKLTVL

SEQ ID NO: 1521 - protein, 108 aa, Artificial Sequence
  Synthetic construct
SYVLTQPPSVSVAPGKTARISYGGDYFGIKSVHWYQQKPGQAPVLAVFDDTDRPSGIPERFSGSNSGNTATLTISRVEVGDEADYYCQVWDSSSEHVVFGGGSKLTVL

SEQ ID NO: 1522 - protein, 108 aa, Artificial Sequence; identical to SEQ ID NO: 1481
  Synthetic construct

SEQ ID NO: 1523 - protein, 108 aa, Artificial Sequence; identical to SEQ ID NO: 1476
  Synthetic construct

SEQ ID NO: 1524 - protein, 108 aa, Artificial Sequence
  Synthetic construct
SYILTQPPSVSVAPGQTATITCGGYNIRSKSVHWYQQRPGQAPVAVVYDDSGRPSGIPARFSGSNSGNTATLTISRVEAGDEADYYCQVWDSSSEHVVFGGGTKLTVL

SEQ ID NO: 1525 - protein, 108 aa, Artificial Sequence; identical to SEQ ID NO: 1477
  Synthetic construct

SEQ ID NO: 1526 - protein, 77 aa, Artificial Sequence
  Synthetic construct
VHWYQQKPGQAPVLVVFDDTDRPSGIPERFSGSNFGNMATLTISRVEVGDEADYYCQVWDSSSEHVVFGGGSKLTVL

SEQ ID NO: 1527 - protein, 22 aa, Artificial Sequence
  Synthetic construct
CQVWDSSSEHVVFGGGSKLTVL

SEQ ID NO: 1528 - protein, 22 aa, Artificial Sequence
  Synthetic construct
CQVWDSSSEHVVFGGGTKLTVL

SEQ ID NO: 1529 - protein, 108 aa, Artificial Sequence; identical to SEQ ID NO: 1481
  Synthetic construct

SEQ ID NO: 1530 - protein, 108 aa, Artificial Sequence
  Synthetic construct
SYVLTQPPSVTVAPGKTATITCGGSYFDIKSVHWYQQEPGQAPVLVVFDDTDRPSGIPERFSGSNSGNTATLTISRVEVGDEADYYCQVWDSSSEHVVFGGVSKLTVL

SEQ ID NO: 1531 - protein, 107 aa, Artificial Sequence; identical to SEQ ID NO: 1497
  Synthetic construct

SEQ ID NO: 1532 - protein, 22 aa, Artificial Sequence
  Synthetic construct
CQVWDSSSEHVVFGGGSKLTVL

SEQ ID NO: 1533 - protein, 108 aa, Artificial Sequence
  Synthetic construct
SYVLTQPPSVSVAPGKTARISCGGDYFGIKSVHWYQQKPGQAPVLVVFDDTDRPSGISERFSGSNSGNTATLTISRVEVGDEADYYCQVWDSSSEHVVFGGGSKLTVL

SEQ ID NO: 1534 - protein, 108 aa, Artificial Sequence
  Synthetic construct
SYVLTQPPSVSGAPGKTARISCGGDYFEIKSVHWYQQKPGQAPVLVVFDDTDRPSGIPERFSGSNSGNTATLTISRVEVGDEADYYCQVWDSSSEHVVFGGGSKLTVL

SEQ ID NO: 1535 - protein, 108 aa, Artificial Sequence
  Synthetic construct
SYVLTQPPSVSVAPGKTARISCGGDYFGIKSVHWYQQKPGQAPVLVVFDDTDRPSGIPERFSGSKSGNTATLTISRVEVGDEADYYCQVWDSSSEHVVFGGGSKLTVL

SEQ ID NO: 1536 - protein, 108 aa, Artificial Sequence; identical to SEQ ID NO: 1474
  Synthetic construct

SEQ ID NO: 1537 - protein, 107 aa, Artificial Sequence
  Synthetic construct
SYVVTQQPSVSVAPGKTARITCGGNNIGNKAVHWYQQRPGQAPVLVIYDDSDRRSGIPERFSGSNSGHTATLTISGVEGGDEADYYCQVWDSSSEHVVFGGGTKLTV

SEQ ID NO: 1538 - protein, 82 aa, Artificial Sequence
  Synthetic construct
FGVKSVHWYQQKPGQAPVVVVFDDTDRPSGIPEGFSGSNSGNTATLTISRVEVGDEADNYCQVWDSSSEHVVFGGGTKLTVL

SEQ ID NO: 1539 - protein, 108 aa, Artificial Sequence
  Synthetic construct
SYVLTQPPSVSVAPGKTARITCGGDYFEVKSVHWYQQKPGQAPVVVVFDDTDRPSGIPERFSGSNSGNTATLTISGVEVGDEADYYCQVWDSSSEHVVFGGGTKLTVL

SEQ ID NO: 1540 - protein, 108 aa, Artificial Sequence
  Synthetic construct
SHVLTQPPSVSVPPGQTARFTCEGNNIGSKSVHWYLQKPGQAPVLVVYDDDDRPSGIPERFSGSNSGNTATLTISRVEVGDEADYYCQVWDSSSEHVVFGGGSKLTVL

SEQ ID NO: 1541 - protein, 108 aa, Artificial Sequence
  Synthetic construct
SYVLTQPPSVSVAPGKTARITCEGNNIGSKNVHWYQQKPGQAPVLVVYDDSDRPSGIPERFSGPNSGNTAILTISRVEAGDEADYYCQVWDSSSEHVVFGGGSKLTVL

SEQ ID NO: 1542 - protein, 107 aa, Artificial Sequence
  Synthetic construct
SYVVTQPPSVSVAPGKTARITCGGNNIGNKAVHWYQQRPGQAPVLVIYDDSDRRSGIPERFSGSNSGHTATLTIGGVEGGDEADYYCQVWDSSSEHVVFGGGTKLTV

SEQ ID NO: 1543 - protein, 108 aa, Artificial Sequence; identical to SEQ ID NO: 1473
  Synthetic construct

SEQ ID NO: 1544 - protein, 108 aa, Artificial Sequence; identical to SEQ ID NO: 1476
  Synthetic construct

SEQ ID NO: 1545 - protein, 108 aa, Artificial Sequence; identical to SEQ ID NO: 1477
  Synthetic construct

SEQ ID NO: 1546 - protein, 108 aa, Artificial Sequence; identical to SEQ ID NO: 1474
  Synthetic construct

SEQ ID NO: 1547 - protein, 108 aa, Artificial Sequence; identical to SEQ ID NO: 1476
  Synthetic construct

SEQ ID NO: 1548 - protein, 108 aa, Artificial Sequence; identical to SEQ ID NO: 1476
  Synthetic construct

SEQ ID NO: 1549 - protein, 108 aa, Artificial Sequence; identical to SEQ ID NO: 1473
  Synthetic construct

SEQ ID NO: 1550 - protein, 108 aa, Artificial Sequence
  Synthetic construct
SYVLTQPPSVSVAPGKTARITCGGDYFEVKSVHWYQQKPGQAPVLVVFDDTDRPSGIPERFSGSNSGNTATLTISRVEVGDEADYYCQVWDSSSEHVVFGGGGKLTVL

SEQ ID NO: 1551 - protein, 60 aa, Artificial Sequence; identical to SEQ ID NO: 1508
  Synthetic construct

SEQ ID NO: 1552 - protein, 60 aa, Artificial Sequence; identical to SEQ ID NO: 1508
  Synthetic construct

SEQ ID NO: 1553 - protein, 107 aa, Artificial Sequence; identical to SEQ ID NO: 1497
  Synthetic construct

SEQ ID NO: 1554 - protein, 108 aa, Artificial Sequence; identical to SEQ ID NO: 1477
  Synthetic construct

SEQ ID NO: 1555 - protein, 22 aa, Artificial Sequence
  Synthetic construct
CQVWDSSSEHVVFGGGSKLTVL

SEQ ID NO: 1556 - protein, 82 aa, Artificial Sequence; identical to SEQ ID NO: 1492
  Synthetic construct

SEQ ID NO: 1557 - protein, 60 aa, Artificial Sequence; identical to SEQ ID NO: 1469
  Synthetic construct

SEQ ID NO: 1558 - protein, 22 aa, Artificial Sequence
  Synthetic construct
CQVWDSSSEHVVFGGGSKLTVL

SEQ ID NO: 1559 - protein, 108 aa, Artificial Sequence
  Synthetic construct
SYVLTQPPSVTVAPGKTATITCGGNYFEIKSVHWYQQKPGQAPVLVVFDDSDRPSGIPERFSGSNSGNTATLTISRVEVGDEADYYCQVWDSSSEHVVFGVGSKLTVL

SEQ ID NO: 1560 - protein, 108 aa, Artificial Sequence
  Synthetic construct
SYVLTQPPSVTVAPGKTATITCGGSYFDIKSVHWYQQKPGQAPVLVVFDDIDRPSGIPERFSGSNSGNTATLTISRVEVGDEADYYCQVWDSSSEHVVFGGGSKLTVL

SEQ ID NO: 1561 - protein, 108 aa, Artificial Sequence; identical to SEQ ID NO: 1481
  Synthetic construct

SEQ ID NO: 1562 - protein, 108 aa, Artificial Sequence
  Synthetic construct
SYVLTQPPSVSVAPGKTTRITCGGDYFEVKSVHWYQQKPGQAPVLVVFDDTDRPSGIPERFSGSNSGNTATLTISRVEVGDEADYYCQVWDSSSEHVVFGGGSKLTVL

SEQ ID NO: 1563 - protein, 60 aa, Artificial Sequence; identical to SEQ ID NO: 1469
  Synthetic construct

SEQ ID NO: 1564 - protein, 22 aa, Artificial Sequence
  Synthetic construct
CQVWDSSSEHVVFGGGSKLTVL

SEQ ID NO: 1565 - protein, 108 aa, Artificial Sequence
  Synthetic construct
SYVLTQPPSVSVAPGKTARISCGGDYFGIKSVHWYQQKPGQAPVLVVFDDTDRPSGIPERFSGSNSWNTATLTISRVEVGDEADYYCQVWDSSSEHVVFGGGSKLTVL

SEQ ID NO: 1566 - protein, 22 aa, Artificial Sequence
  Synthetic construct
CQVWDSSSEHVVFGGGSKLTVL

SEQ ID NO: 1567 - protein, 82 aa, Artificial Sequence
  Synthetic construct
FGIKSVHWYQQKPGQAPVLVVFDDTDRPSGIPERFSGSNSGNTATLTISRVEVGDKADYYCQVWDSSSEHVVFGGGSKLTVL

SEQ ID NO: 1568 - protein, 108 aa, Artificial Sequence; identical to SEQ ID NO: 1476
  Synthetic construct

SEQ ID NO: 1569 - protein, 22 aa, Artificial Sequence
  Synthetic construct
CQVWDSSSEHVVFGGGSKLTVL

SEQ ID NO: 1570 - protein, 108 aa, Artificial Sequence; identical to SEQ ID NO: 1481
  Synthetic construct

SEQ ID NO: 1571 - protein, 108 aa, Artificial Sequence; identical to SEQ ID NO: 1476
  Synthetic construct

SEQ ID NO: 1572 - protein, 60 aa, Artificial Sequence; identical to SEQ ID NO: 1508
  Synthetic construct

SEQ ID NO: 1573 - protein, 108 aa, Artificial Sequence; identical to SEQ ID NO: 1481
  Synthetic construct

SEQ ID NO: 1574 - protein, 108 aa, Artificial Sequence; identical to SEQ ID NO: 1476
  Synthetic construct

SEQ ID NO: 1575 - protein, 108 aa, Artificial Sequence
  Synthetic construct
SYVLTQPPSVSVAPGKTARISCGGDYFGIKSVHWYQQKPGQAPVLVVFDDTDRLSGIPERFSGSNSGNTATLTISRVEVGDEADYYCQVWDSSSEHVVFGGGSKLTVL

SEQ ID NO: 1576 - protein, 108 aa, Artificial Sequence; identical to SEQ ID NO: 1481
  Synthetic construct

SEQ ID NO: 1577 - protein, 108 aa, Artificial Sequence; identical to SEQ ID NO: 1474
  Synthetic construct

SEQ ID NO: 1578 - protein, 22 aa, Artificial Sequence
  Synthetic construct
CQVWDSSSEHVVFGGGSKLTVL

SEQ ID NO: 1579 - protein, 108 aa, Artificial Sequence; identical to SEQ ID NO: 1481
  Synthetic construct

SEQ ID NO: 1580 - protein, 108 aa, Artificial Sequence; identical to SEQ ID NO: 1476
  Synthetic construct

SEQ ID NO: 1581 - protein, 108 aa, Artificial Sequence; identical to SEQ ID NO: 1481
  Synthetic construct

SEQ ID NO: 1582 - protein, 108 aa, Artificial Sequence
  Synthetic construct
SYVLTQPPSVSVAPGQTARITCGGNDIGSKSVHWYQQKPGQAPVLVVYDDSDRPSGIPERFSGSNSGNTATLTISRVEAGDEAGYYCQVWDSSSEHVVFGGGTKLTVL

SEQ ID NO: 1583 - protein, 22 aa, Artificial Sequence
  Synthetic construct
CQVWDSSSEHVVFGGGSKLTVL

SEQ ID NO: 1584 - protein, 108 aa, Artificial Sequence; identical to SEQ ID NO: 1473
  Synthetic construct

SEQ ID NO: 1585 - protein, 108 aa, Artificial Sequence; identical to SEQ ID NO: 1481
  Synthetic construct

SEQ ID NO: 1586 - protein, 107 aa, Artificial Sequence
  Synthetic construct
SYVVTQPPSVSVAPGKTARITCGGNNIGNKAVHWYQQRPGQAPVLVIYDDSDRRSGIPERFSGSNAGHTATLTISGVEGGDEADYYCQVWDSSSEHVVFGGGTKLTV

SEQ ID NO: 1587 - protein, 22 aa, Artificial Sequence
  Synthetic construct
CQVWDSSSEHVVFGGGSKLTVL

SEQ ID NO: 1588 - protein, 108 aa, Artificial Sequence; identical to SEQ ID NO: 1474
  Synthetic construct

SEQ ID NO: 1589 - protein, 108 aa, Artificial Sequence
  Synthetic construct
SYVLTQPPSVSVAPGKTARITCGGDYFEVKSIHWYQQKPGQAPVVVVFDDTDRPSGIPERFSGSNSGNTATLTISRVEVGDEADYYCQVWDSSSEHVVFGGGTKLTVL

SEQ ID NO: 1590 - protein, 108 aa, Artificial Sequence; identical to SEQ ID NO: 1474
  Synthetic construct

SEQ ID NO: 1591 - protein, 107 aa, Artificial Sequence; identical to SEQ ID NO: 1497
  Synthetic construct

SEQ ID NO: 1592 - protein, 22 aa, Artificial Sequence
  Synthetic construct
CQVWDSSSEHVVFGGGTKLTVL

SEQ ID NO: 1593 - protein, 22 aa, Artificial Sequence
  Synthetic construct
CQVWDSSSEHVVFGGGSKLTVL

SEQ ID NO: 1594 - protein, 22 aa, Artificial Sequence
  Synthetic construct
CQVWDSSSEHVVFGGGSKLTVL

SEQ ID NO: 1595 - protein, 108 aa, Artificial Sequence
  Synthetic construct
SYVLTQPPSVSVAPGKTARITCGGDNIGSKSVHWYQQKPGQAPVLVVYDDSDRPSGIPERFSGSNFGNTATLTISRVEAGDEADYYCQVWDSSSEHVVFGGGTKLTVL

SEQ ID NO: 1596 - protein, 108 aa, Artificial Sequence; identical to SEQ ID NO: 1477
  Synthetic construct

SEQ ID NO: 1597 - protein, 108 aa, Artificial Sequence; identical to SEQ ID NO: 1476
  Synthetic construct

SEQ ID NO: 1598 - protein, 108 aa, Artificial Sequence
  Synthetic construct
SYVLTQPPSVSVAPGKTARISCGGDYFGIKSVHWYQQKPGQAPVLVVFDDTDRPSGIPERFSSSNSGNTATLTISRVEVGDEADYYCQVWDSSSEHVVFGGGSKLTVL

SEQ ID NO: 1599 - protein, 22 aa, Artificial Sequence
  Synthetic construct
CQVWDSSSEHVVFGGGSKLTVL

SEQ ID NO: 1600 - protein, 22 aa, Artificial Sequence
  Synthetic construct
CQVWDSSSEHVVFGGGTKLTVL

SEQ ID NO: 1601 - protein, 60 aa, Artificial Sequence; identical to SEQ ID NO: 1469
  Synthetic construct

SEQ ID NO: 1602 - protein, 108 aa, Artificial Sequence; identical to SEQ ID NO: 1481
  Synthetic construct

SEQ ID NO: 1603 - protein, 22 aa, Artificial Sequence
  Synthetic construct
CQVWDSSSEHVVFGGGSKLTVL

SEQ ID NO: 1604 - protein, 108 aa, Artificial Sequence; identical to SEQ ID NO: 1476
  Synthetic construct

SEQ ID NO: 1605 - protein, 108 aa, Artificial Sequence; identical to SEQ ID NO: 1481
  Synthetic construct

SEQ ID NO: 1606 - protein, 108 aa, Artificial Sequence; identical to SEQ ID NO: 1476
  Synthetic construct

SEQ ID NO: 1607 - protein, 22 aa, Artificial Sequence
  Synthetic construct
CQVWDSSSEHVVFGGGSKLTVL

SEQ ID NO: 1608 - protein, 108 aa, Artificial Sequence; identical to SEQ ID NO: 1481
  Synthetic construct

SEQ ID NO: 1609 - protein, 22 aa, Artificial Sequence
  Synthetic construct
CQVWDSSSEHVVFGGGSKLTVL

SEQ ID NO: 1610 - protein, 60 aa, Artificial Sequence; identical to SEQ ID NO: 1508
  Synthetic construct

SEQ ID NO: 1611 - protein, 108 aa, Artificial Sequence; identical to SEQ ID NO: 1474
  Synthetic construct

SEQ ID NO: 1612 - protein, 59 aa, Artificial Sequence
  Synthetic construct
DDSDRRSGIPERFSGSNSGHTATLTISGVEGGDEADYYCQVWDSSSEHVVFGGGTKLTV

SEQ ID NO: 1613 - protein, 108 aa, Artificial Sequence; identical to SEQ ID NO: 1481
  Synthetic construct

SEQ ID NO: 1614 - protein, 60 aa, Artificial Sequence; identical to SEQ ID NO: 1508
  Synthetic construct

SEQ ID NO: 1615 - protein, 22 aa, Artificial Sequence
  Synthetic construct
CQVWDSSSEHVVFGGGSKLTVL

SEQ ID NO: 1616 - protein, 108 aa, Artificial Sequence; identical to SEQ ID NO: 1476
  Synthetic construct

SEQ ID NO: 1617 - protein, 108 aa, Artificial Sequence; identical to SEQ ID NO: 1534
  Synthetic construct

SEQ ID NO: 1618 - protein, 108 aa, Artificial Sequence; identical to SEQ ID NO: 1474
  Synthetic construct

SEQ ID NO: 1619 - protein, 108 aa, Artificial Sequence; identical to SEQ ID NO: 1474
  Synthetic construct

SEQ ID NO: 1620 - protein, 22 aa, Artificial Sequence
  Synthetic construct
CQVWDSSSEHVVFGGGSKLTVL

SEQ ID NO: 1621 - protein, 22 aa, Artificial Sequence
  Synthetic construct
CQVWDSSSEHVVFGGGSKLTVL

SEQ ID NO: 1622 - protein, 22 aa, Artificial Sequence
  Synthetic construct
CQVWDSSSEHVVFGGGSKLTVL

SEQ ID NO: 1623 - protein, 108 aa, Artificial Sequence; identical to SEQ ID NO: 1481
  Synthetic construct

SEQ ID NO: 1624 - protein, 22 aa, Artificial Sequence
  Synthetic construct
CQVWDSSSEHVVFGGGSKLTVL

SEQ ID NO: 1625 - protein, 22 aa, Artificial Sequence
  Synthetic construct
CQVWDSSSEHVVFGGGSKLTVL

SEQ ID NO: 1626 - protein, 59 aa, Artificial Sequence; identical to SEQ ID NO: 1612
  Synthetic construct

SEQ ID NO: 1627 - protein, 82 aa, Artificial Sequence
  Synthetic construct
FEIKSVHWYQQKPGQAPVLVVFDDSDRPSGIPERFSGSNSGNTATLTISRVEVGDEADYYCQVWDSSSEHVVFGGGSKLTVL

SEQ ID NO: 1628 - protein, 77 aa, Artificial Sequence
  Synthetic construct
VHWYQQKPGQAPVLVVFDDTDRPSGIPERFSGSNSGNTATLTISRVEVGDEADYYCQVWDSSSEHVVFGGGSKLTVL

SEQ ID NO: 1629 - protein, 108 aa, Artificial Sequence; identical to SEQ ID NO: 1476
  Synthetic construct

SEQ ID NO: 1630 - protein, 22 aa, Artificial Sequence
  Synthetic construct
CQVWDSSSEHVVFGGGTKLTVL

SEQ ID NO: 1631 - protein, 108 aa, Artificial Sequence; identical to SEQ ID NO: 1477
  Synthetic construct

SEQ ID NO: 1632 - protein, 22 aa, Artificial Sequence
  Synthetic construct
CQVWDSSSEHVVFGGGSKLTVL

SEQ ID NO: 1633 - protein, 60 aa, Artificial Sequence; identical to SEQ ID NO: 1469
  Synthetic construct

SEQ ID NO: 1634 - protein, 60 aa, Artificial Sequence; identical to SEQ ID NO: 1508
  Synthetic construct

SEQ ID NO: 1635 - protein, 108 aa, Artificial Sequence; identical to SEQ ID NO: 1477
  Synthetic construct

SEQ ID NO: 1636 - protein, 108 aa, Artificial Sequence; identical to SEQ ID NO: 1476
  Synthetic construct

SEQ ID NO: 1637 - protein, 108 aa, Artificial Sequence
  Synthetic construct
SYVLTQPPSVTVAPGKTATITCGGSYFDIKSIHWYQQKPGQAPVLVVFDDTDRPSGIPERFSGSNSGNTATLTISRVEVGDEADYYCQVWDSSSEHVVFGGGSKLTVL

SEQ ID NO: 1638 - protein, 108 aa, Artificial Sequence; identical to SEQ ID NO: 1473
  Synthetic construct

SEQ ID NO: 1639 - protein, 83 aa, Artificial Sequence
  Synthetic construct
NIGSKSVHWYQQKPGQAPVLVVFDDTDRPSGIPERFSGSNSGNTATLTISRVEVGDEADYYCQVWDSSSEHVVFGGGSKLTVL

SEQ ID NO: 1640 - protein, 108 aa, Artificial Sequence; identical to SEQ ID NO: 1474
  Synthetic construct

SEQ ID NO: 1641 - protein, 82 aa, Artificial Sequence; identical to SEQ ID NO: 1492
  Synthetic construct

SEQ ID NO: 1642 - protein, 22 aa, Artificial Sequence
  Synthetic construct
CQVWDSSSEHVVFGGGTKLTVL

SEQ ID NO: 1643 - protein, 108 aa, Artificial Sequence; identical to SEQ ID NO: 1476
  Synthetic construct

SEQ ID NO: 1644 - protein, 60 aa, Artificial Sequence; identical to SEQ ID NO: 1469
  Synthetic construct

SEQ ID NO: 1645 - protein, 108 aa, Artificial Sequence
  Synthetic construct
SYVLTQPPSVSVAPGKMARITCGGDYFEVKSVHWYQQKPGQAPVVVVFDDTDRPSGIPERFSGSNSGNTATLTISRVEVGDEADYYCQVWDSSSEHVVFGGGTKLTVL

SEQ ID NO: 1646 - protein, 108 aa, Artificial Sequence; identical to SEQ ID NO: 1481
  Synthetic construct

SEQ ID NO: 1647 - protein, 22 aa, Artificial Sequence
  Synthetic construct
CQVWDSSSEHVVFGGGSKLTVL

SEQ ID NO: 1648 - protein, 108 aa, Artificial Sequence; identical to SEQ ID NO: 1474
  Synthetic construct

SEQ ID NO: 1649 - protein, 108 aa, Artificial Sequence; identical to SEQ ID NO: 1474
  Synthetic construct

SEQ ID NO: 1650 - protein, 108 aa, Artificial Sequence; identical to SEQ ID NO: 1476
  Synthetic construct

SEQ ID NO: 1651 - protein, 22 aa, Artificial Sequence
  Synthetic construct
CQVWDSSSEHVVFGGGSKLTVL

SEQ ID NO: 1652 - protein, 60 aa, Artificial Sequence; identical to SEQ ID NO: 1469
  Synthetic construct

SEQ ID NO: 1653 - protein, 90 aa, Artificial Sequence
  Synthetic construct
SYVLTQPPSVSVAPGQTARITCGGNNIGSKSDSDRPSGIPARFSGSNSGNTATLTISRVEAGDEADYYCQVWDSSSEHVVFGGGTKLTVL

SEQ ID NO: 1654 - protein, 108 aa, Artificial Sequence; identical to SEQ ID NO: 1481
  Synthetic construct

SEQ ID NO: 1655 - protein, 108 aa, Artificial Sequence
  Synthetic construct
SYVLTQPPSVSVAPGKAARITCGGDYFEVKSVHWYQQKPGQAPVVVVFDDTDRPSGIPERFSGSNSWNTATLTISRVEVGDEADYYCQVWDSSSEHVVFGGGTKLTVL

SEQ ID NO: 1656 - protein, 82 aa, Artificial Sequence
  Synthetic construct
FLTKSVHWYQQQPGQAPVLVVYDDSDRPSGIPERFSGSNSGKTATLTISRVEAGDEADFYCQVWDSSSEHVVFGGGNKLTVL

SEQ ID NO: 1657 - protein, 107 aa, Artificial Sequence; identical to SEQ ID NO: 1497
  Synthetic construct

SEQ ID NO: 1658 - protein, 108 aa, Artificial Sequence; identical to SEQ ID NO: 1481
  Synthetic construct

SEQ ID NO: 1659 - protein, 108 aa, Artificial Sequence
  Synthetic construct
SYVLTQPPSVTVAPGKTATITCGGSYFDIKSVHWYQQKPGQAPVLVVFDDTDRPSGIPERFSGSNSGNTATLTISRVEGGDEADYYCQVWDSSSEHVVFGGGSKLTVL

SEQ ID NO: 1660 - protein, 108 aa, Artificial Sequence; identical to SEQ ID NO: 1474
  Synthetic construct

SEQ ID NO: 1661 - protein, 108 aa, Artificial Sequence
  Synthetic construct
SYVLTQPPSVTVAPGKTATITCGGSYFDIKSVHWYQQKPGQAPVLVVFDDTDRPSGIPERFSGSNSGNTDTLTISRVEVGDEADYYCQVWDSSSEHVVFGGGSKLTVL

SEQ ID NO: 1662 - protein, 107 aa, Artificial Sequence
  Synthetic construct
SYVVTQPPSVSVAPGKTARITCGGNNIGNKAVHWYQQRPGQAPVLVIYDDSDRRSGIPERFSASNSGHTATLTISGVEGGDEADYYCQVWDSSSEHVVFGGGTKLTV

SEQ ID NO: 1663 - protein, 108 aa, Artificial Sequence; identical to SEQ ID NO: 1481
  Synthetic construct

SEQ ID NO: 1664 - protein, 107 aa, Artificial Sequence; identical to SEQ ID NO: 1497
  Synthetic construct

SEQ ID NO: 1665 - protein, 108 aa, Artificial Sequence
  Synthetic construct
SYVPTQPPSVSVAPGKTARISCGGDYFEIKSVHWYQQKPGQAPALVVFDDTDRPSGIPARFSGSNSGNTATLTISRVEVGDEADYYCQVWDSSSEHVVFGGGSKLTVL

SEQ ID NO: 1666 - protein, 108 aa, Artificial Sequence; identical to SEQ ID NO: 1481
  Synthetic construct

SEQ ID NO: 1667 - protein, 60 aa, Artificial Sequence; identical to SEQ ID NO: 1469
  Synthetic construct

SEQ ID NO: 1668 - protein, 108 aa, Artificial Sequence
  Synthetic construct
SYVLTQPPSVSVAPGKTARISCGGDYFEIKSVHWYQQKPGQAPVLIVFDDTDRPSGIPERVSGSNSGNTATLTISRVEVGDEADYYCQVWDSSSEHVVFGGGSKLTVL

SEQ ID NO: 1669 - protein, 108 aa, Artificial Sequence; identical to SEQ ID NO: 1476
  Synthetic construct

SEQ ID NO: 1670 - protein, 77 aa, Artificial Sequence; identical to SEQ ID NO: 1628
  Synthetic construct

SEQ ID NO: 1671 - protein, 60 aa, Artificial Sequence; identical to SEQ ID NO: 1508
  Synthetic construct

SEQ ID NO: 1672 - protein, 82 aa, Artificial Sequence; identical to SEQ ID NO: 1492
  Synthetic construct

SEQ ID NO: 1673 - protein, 107 aa, Artificial Sequence; identical to SEQ ID NO: 1497
  Synthetic construct

SEQ ID NO: 1674 - protein, 22 aa, Artificial Sequence
  Synthetic construct
CQVWDSSSEHVVFGGGSKLTVL

SEQ ID NO: 1675 - protein, 60 aa, Artificial Sequence; identical to SEQ ID NO: 1508
  Synthetic construct

SEQ ID NO: 1676 - protein, 22 aa, Artificial Sequence
  Synthetic construct
CQVWDSSSEHVVFGGGSKLTVL

SEQ ID NO: 1677 - protein, 22 aa, Artificial Sequence
  Synthetic construct
CQVWDSSSEHVVFGGGTKLTVL

SEQ ID NO: 1678 - protein, 22 aa, Artificial Sequence
  Synthetic construct
CQVWDSSSEHVVFGGGSKLTVL

SEQ ID NO: 1679 - protein, 108 aa, Artificial Sequence; identical to SEQ ID NO: 1476
  Synthetic construct

SEQ ID NO: 1680 - protein, 59 aa, Artificial Sequence
  Synthetic construct
DTDRPSGIPERFSGSNSGNTATLTISRVEVGDEADYYCQVWDSSSEHVVFGGGSKLTVL

SEQ ID NO: 1681 - protein, 60 aa, Artificial Sequence; identical to SEQ ID NO: 1469
  Synthetic construct

SEQ ID NO: 1682 - protein, 22 aa, Artificial Sequence
  Synthetic construct
CQVWDSSSEHVVFGGGSKLTVL

SEQ ID NO: 1683 - protein, 108 aa, Artificial Sequence
  Synthetic construct
SYELTQPPSVSVAPGKTARISCGGDYFGIKSVHWYQQKPGQAPVLVVFDDTDRPSGIPERFSGSNSGNTATLTISRVEVGDEADYYCQVWDSSSEHVVFGGGSKLTVL

SEQ ID NO: 1684 - protein, 60 aa, Artificial Sequence; identical to SEQ ID NO: 1469
  Synthetic construct

SEQ ID NO: 1685 - protein, 22 aa, Artificial Sequence
  Synthetic construct
CQVWDSSSEHVVFGGGSKLTVL

SEQ ID NO: 1686 - protein, 60 aa, Artificial Sequence; identical to SEQ ID NO: 1469
  Synthetic construct

SEQ ID NO: 1687 - protein, 22 aa, Artificial Sequence
  Synthetic construct
CQVWDSSSEHVVFGGGSKLTVL

SEQ ID NO: 1688 - protein, 108 aa, Artificial Sequence; identical to SEQ ID NO: 1474
  Synthetic construct

SEQ ID NO: 1689 - protein, 108 aa, Artificial Sequence; identical to SEQ ID NO: 1474
  Synthetic construct

SEQ ID NO: 1690 - protein, 108 aa, Artificial Sequence
  Synthetic construct
SYVLTQPPSVTVAPGKTATITCGGSYFDIKSVHWYQQKPGQAPVLVVFDDTDRPSGVPERFSGSNSGNTATLTISRVEVGDEADYYCQVWDSSSEHVVFGGGSKLTVL

SEQ ID NO: 1691 - protein, 81 aa, Artificial Sequence
  Synthetic construct
IGIRSVHWYRQKSRLAPTLVVYDDTERPSGIPERVSGSTSGDTATLTISRVEVGDEADYYCQACDSSSDHVVFGGGTKLTV

SEQ ID NO: 1692 - protein, 108 aa, Artificial Sequence
  Synthetic construct
SYVLTQPPSVSVAPGQTARITCGGNNIGSKSVHWYQQKPGQAPVLVVHDDSDRPSGIPERFSGSNSGNTATLTISRVEAGDEADYYCQAWDSSNDHVVFGGGTKLTVL

SEQ ID NO: 1693 - protein, 108 aa, Artificial Sequence
  Synthetic construct
SYVLTQPPSVSVAPGQTARITCGGNIIGSKSVHWYQQKPGQAPVVVVYDDSDRPTGIPERFSGSNSGNTATLTISRVEAGDEADYYCQLWDSSSEHVVFGGGTKLTAL

SEQ ID NO: 1694 - protein, 123 aa, Artificial Sequence
  Synthetic construct
QVRLEQSGAEVMKPGASVKVSCRASGYSFTPFYILWVRQAPGQGLEWMGIINPSGGGTTYAQSFQGRVTMTRDRSTNTVYMELRSLRSEDTAVYFCARVAPPGVVNNKWFDIWGQGTLVTVSS

SEQ ID NO: 1695 - protein, 123 aa, Artificial Sequence
  Synthetic construct
QVHLVQSGTEVKQPGASVKVSCKASGYTFTTYYINWVRQAPGQGLEWVGMINPTGGSTTYAQKFQGRVTLTRDRSTSTVYMELRSLRSEDTAVFYCARVPPPGVVNNKWLDLWGQGTLVTVSS

SEQ ID NO: 1696 - protein, 64 aa, Artificial Sequence
  Synthetic construct
YAQKFQGRVTLTRDRSTSTVYMELRSLRSEDTAVFYCARVPPPGVVNNKWLDLWGQGTLVTVSS

SEQ ID NO: 1697 - protein, 64 aa, Artificial Sequence; identical to SEQ ID NO: 1696
  Synthetic construct

SEQ ID NO: 1698 - protein, 64 aa, Artificial Sequence; identical to SEQ ID NO: 1696
  Synthetic construct

SEQ ID NO: 1699 - protein, 123 aa, Artificial Sequence
  Synthetic construct
QVHLVQSGTEVKQPGASVKASCKASGYTFTTYYINWVRQAPGQGLEWVGMINPTGGSTTYAQKFQGRVTLTRDRSTSTVYMELRSLRSEDTAVFYCARVPPPGVVNNKWLDLWGQGTLVTVSS

SEQ ID NO: 1700 - protein, 123 aa, Artificial Sequence
  Synthetic construct
QVHLVQSGTEVKQPGASVKVSCKASGYTFTTYYINWVRQAPGQGLEWVGMINPTGGSTTYALEFQGRVTLTRDRSTSTVYMELRSLRSEDTAVFYCARVPPPGVVNNKWLDLWGQGTLVTVSS

SEQ ID NO: 1701 - protein, 123 aa, Artificial Sequence; identical to SEQ ID NO: 1695
  Synthetic construct

SEQ ID NO: 1702 - protein, 123 aa, Artificial Sequence
  Synthetic construct
QVQLVQSGAEVKKPGASVRVSCKASGYTFTGFYINWVRQAPGQGLEWMAIINPSGITTSIAEKFQGRVTMTRDTSTSTVYMELRSLRSEDTAVYYCARGPPPGVANHKWFDTWGQGTLVTVSS

SEQ ID NO: 1703 - protein, 73 aa, Artificial Sequence
  Synthetic construct
INPSGGGTTYAQSFQGRVTMTRDRSTSTVYMELRSLRSEDTAVYYCARVAPPGVVNNKWFDTWGQGTLVTVSS

SEQ ID NO: 1704 - protein, 123 aa, Artificial Sequence
  Synthetic construct
QVRLEQSGAEVMKPGASVKVSCRASGYSFTPFYILWVRQATGQGLEWMGIINPSGGGTTYAQSFQGRVTMTRDRSTSTVYMELRSLRSEDTAVYYCARVAPPGVVNNKWFDTWGQGTLVTVSS

SEQ ID NO: 1705 - protein, 123 aa, Artificial Sequence; identical to SEQ ID NO: 1704
  Synthetic construct

SEQ ID NO: 1706 - protein, 123 aa, Artificial Sequence
  Synthetic construct
QVRLEQSGAEVMKPGASVKVSCRASGYSFTPFYILWVRQATGQGLEWMGIINPSGGGTTYAQSFQGRVTMTRDRSTSTVYMELRSLRSKDTAVYYCARVAPPGVVNNKWFDTWGQGTLVTVSS

SEQ ID NO: 1707 - protein, 123 aa, Artificial Sequence
  Synthetic construct
QVRLEQSGAEVMKPGASVKVSCRASGYSFTPFYILWVRQATGQGLEWMGIINPRGGGTTYAQSFQGRVTMTRDRSTSTVYMELRSLRSEDTAVYYCARVAPPGVVNNKWFDTWGQGTLVTVSS

SEQ ID NO: 1708 - protein, 98 aa, Artificial Sequence
  Synthetic construct
GYSFTPFYILWVRQATGQGLEWMGIINPSGGGTTYAQSFQGRVTMTRDRSTSTVYMELRSLRSEDTAVYYCARVAPPGVVNNKWFDTWGQGTLVTVSS

SEQ ID NO: 1709 - protein, 73 aa, Artificial Sequence; identical to SEQ ID NO: 1703
  Synthetic construct

SEQ ID NO: 1710 - protein, 98 aa, Artificial Sequence; identical to SEQ ID NO: 1708
  Synthetic construct

SEQ ID NO: 1711 - protein, 98 aa, Artificial Sequence
  Synthetic construct
GYTFTGFYINWVRQAPGQGLEWMAIINPSGITTSIAEKFQGRVTMTRDTSTSTVYMELRSLRSEDTAVYYCARVPPPGVANHKWFDTWGQGTLVTVSS

SEQ ID NO: 1712 - protein, 98 aa, Artificial Sequence; identical to SEQ ID NO: 1711
  Synthetic construct

SEQ ID NO: 1713 - protein, 98 aa, Artificial Sequence; identical to SEQ ID NO: 1711
  Synthetic construct

SEQ ID NO: 1714 - protein, 98 aa, Artificial Sequence; identical to SEQ ID NO: 1711
  Synthetic construct

SEQ ID NO: 1715 - protein, 123 aa, Artificial Sequence
  Synthetic construct
QVHLVQSGADVKKPGASVKISCKASGNAFTPYYMSWVRQAPGQGLEWLGIINPSGGSTTYAPKFQGRLTMTRDRSANTVYMELSGLTSEDTAVYFCARITPPGVVNNKWFDLWGQGALVTVSS

SEQ ID NO: 1716 - protein, 122 aa, Artificial Sequence
  Synthetic construct
QVQLVQSGAEVKKPGASVKVSRKASGNTFSRYYINWVRQAPGQGLQWMGIINPSGKTSGFAQIFQGRLTMTSDASTNTGCMEMSSLRSEDTAVYYCARVSPPGVVNKKWFDIWGQGTLVTVS

SEQ ID NO: 1717 - protein, 96 aa, Artificial Sequence
  Synthetic construct
NTFSRYYINWVRQAPGQGLQWMGIINPSGKTSGFAQIFQGRLTMTSDASTNTVFMEMSSLRSEDTAVYYCARVSPPGVVNKKWFDIWGQGTLVTVS

SEQ ID NO: 1718 - protein, 126 aa, Artificial Sequence
  Synthetic construct
EGQVVESGGGLVQPGGSLRLSCAVSGLTFSTSEFAWVRQAPGKGLEWLSFIGRGSSIYYADSVRGRFTVSRDNAKNSLYLQMNSLRVEDTALYYCARSEKRVTMTRKIKGRWFGPWGQGTLVTVSS

SEQ ID NO: 1719 - protein, 125 aa, Artificial Sequence
  Synthetic construct
EVQLVESGGGLVQPGGSLRLSCEVSGLTFTTSEFNWVRQAPGKGLEWLSFGRGSTIYYADSVKGRFTVSRDNAKSSLYLQMSSLRVEYTALYYCTRSEKRITLARKIKGRWFDPWGQGTLVTVSS

SEQ ID NO: 1720 - protein, 99 aa, Artificial Sequence
  Synthetic construct
TFTTSEFNWVRQAPGKGLEWLSFIGRGSTIYYADSVKGRFTVSRDNAKSSLYLQMSSLRVEDTALYYCTRSEKRITLARKIKGRWFDPWGQGTPVTVSS

SEQ ID NO: 1721 - protein, 99 aa, Artificial Sequence
  Synthetic construct
TFTTSEFNWVRQAPGKGLEWLSFIGRGSTIYYADSVKGRFTVSRDNAKSSLYLQMSSLRVEDTALYYCTRSEKRITLARKIKGRWFDPWGQGTLVTVSS

SEQ ID NO: 1722 - protein, 99 aa, Artificial Sequence
  Synthetic construct
TFTTSEFNWVRQAPGKGLEWLSFIGRGSTIYYADSVKGRFTVSRDNAKSSLYLQMSSLRVEDTALYYCTRSEKRITLARKIKGRWFDPWGQGILVTVSS

SEQ ID NO: 1723 - protein, 94 aa, Artificial Sequence
  Synthetic construct
GLTFRTSEFNWVRQAPGKGLEWLSYYYADSVKGRFTVSRDNTKNSVYLQMDSLKVEDTALYYCTRSENRLTLARKIKGRWFGPWGQGTLVTVSS

SEQ ID NO: 1724 - protein, 125 aa, Artificial Sequence
  Synthetic construct
EVQLVESGGGLVQPGGSLRLSCPVSGLTVSTSEFTWVRQAPGKGLEWLSYGRGSTIYYADSVKGRFTVSRDNAKNSLYLQLNSLRVEDTAVYYCSRSEPRKTTARKIKGRWFDPWGQGILVTVSS

SEQ ID NO: 1725 - protein, 74 aa, Artificial Sequence
  Synthetic construct
RGSTIYYADSVKGRFTVSRDNAKNSLYLQLNSLRVEDTAVYYCSRSEPRKTTARKIKGRWFDPWGQGILVTVSS

SEQ ID NO: 1726 - protein, 74 aa, Artificial Sequence; identical to SEQ ID NO: 1725
  Synthetic construct

SEQ ID NO: 1727 - protein, 74 aa, Artificial Sequence; identical to SEQ ID NO: 1725
  Synthetic construct

SEQ ID NO: 1728 - protein, 125 aa, Artificial Sequence
  Synthetic construct
EVQLVESGGGLVQPGGSLRLSCEVSGLTFTTSEFNWVRQAPGKGLEWLSFGRGSTIYYADSVKGRFTVSRDNAKSSLYLQMSSLRVEDTALYYCTRSEKRITLVRKIKGRWFDPWGQGTLVTVSS

SEQ ID NO: 1729 - protein, 119 aa, Artificial Sequence
  Synthetic construct
EVQVVESGGALVQPGGSLRLSCAASGFTFKTSELNWVRQAPGKGLEWLSYYYADSGRGRFTIARDNAKNSLFLQMNSLRVEDTGVYYCARSEKRITMARKIKGRWFDPWGEGILVTVSS

SEQ ID NO: 1730 - protein, 77 aa, Artificial Sequence
  Synthetic construct
ISSGSGTIYYADSVRGRFTISRDNAKNSLFLQMNSLRVEDTGVYYCARSEKRITMARKIKGRWFDPWGEGILVTVSS

SEQ ID NO: 1731 - protein, 127 aa, Artificial Sequence
  Synthetic construct
EVQVVESGGALVQPGGSLRLSCAASGFTFKTSELNWVRQAPGKGLEWLSYISSGSGTIYYADSVRGRFTISRDNAKNSLFLQMNSLRVEDTGVYYCARSEKRITMARKIKGRWFDPWGEGILVTVSS

SEQ ID NO: 1732 - protein, 127 aa, Artificial Sequence; identical to SEQ ID NO: 1731
  Synthetic construct

SEQ ID NO: 1733 - protein, 127 aa, Artificial Sequence
  Synthetic construct
EVQVVESGGALVQPGGSLRLSCAASGFTFKTSELNWVRQAPGKGLEWLSYISSGSGTIYYADSVRGRFNISRDNAKNSLFLQMNSLRVEDTGVYYCARSEKRITMARKIKGRWFDPWGEGILVTVSS

SEQ ID NO: 1734 - protein, 127 aa, Artificial Sequence
  Synthetic construct
EVQVVESGGALVQPGGSLRLSCAASGFTFKTSELNWVRQAPGKGLEWLSYISSGSGTIYYADSVRGRLTISRDNAKNSLFLQMNSLRVEDTGVYYCARSEKRITMARKIKGRWFDPWGEGILVTVSS

SEQ ID NO: 1735 - protein, 119 aa, Artificial Sequence
  Synthetic construct
EVQVVESGGALVQPGGSLRLSCAASGFTFKTSELNWVRQAPGKGLEWLSYYYADSVRGRFTISRDNAKNSLFLQMNSLRVEDTGVYYCARSEKRITMARKIKGRWFDPWGEGILVTVSS

SEQ ID NO: 1736 - protein, 127 aa, Artificial Sequence
  Synthetic construct
EVQVVESGGALVQPGGSLRLSCAASGFTFKTSELNWVRQAPGKRLEWLSYISSGSGTIYYADSVRGRFTISRDNAKNSLFLQMNSLRVEDTGVYYCARSEKRITMARKIKGRWFDPWGEGILVTVSS

SEQ ID NO: 1737 - protein, 77 aa, Artificial Sequence; identical to SEQ ID NO: 1730
  Synthetic construct

SEQ ID NO: 1738 - protein, 77 aa, Artificial Sequence; identical to SEQ ID NO: 1730
  Synthetic construct

SEQ ID NO: 1739 - protein, 127 aa, Artificial Sequence
  Synthetic construct
EVQVVESGGALVQPGGSLRLSCAASGFTFKTSELNWVRQAPGKGLEWLSYISSGSGTIYYADSVRGRFTISRDNAKNSLFLQMNGLRVEDTGVYYCARSEKRITMARKIKGRWFDPWGEGILVTVSS

SEQ ID NO: 1740 - protein, 126 aa, Artificial Sequence
  Synthetic construct
EVQVVESGGALVQPGGSLRLSCAASGFTFKTSELNWVRQAPGKGLEWLSYISSGSGTIYYADSVRGRFTISRDNAKNSLFLQMNSLRVEDTGVYYCARSEKRITMARKIKGRWFDPWGEGILVTVS

SEQ ID NO: 1741 - protein, 127 aa, Artificial Sequence
  Synthetic construct
EVQLVESGGGLVQPGGSLRLSCVVSGLTFSASEFTWVRQAPGQGLEWLSYIGRGSSTIYYVDSVKGRFTVSRDNAKNSLYLQMNSLRVEDTALYYCTRSEKRNTMARKIKGRWFDSWGQGTLVTVAS

SEQ ID NO: 1742 - protein, 69 aa, Artificial Sequence
  Synthetic construct
YYADSVKGRFTVSRDNAKNSLYLQMNSLRVEDTALYYCTRSEKRNTMARKIKGRWFDSWGQGTLVTVAS

SEQ ID NO: 1743 - protein, 127 aa, Artificial Sequence
  Synthetic construct
EVQLVESGGGLVQPGGSLRLSCVVSGLTFSASEFTWVRQAPGQGLEWLSYIGRGSSTIYYADSVKGRFTVSRDNAKNSLYLQMNSLRVEDTALYYCTRSEKRNTMARKIKGRWFDSWGQGTLVTVAS

SEQ ID NO: 1744 - protein, 127 aa, Artificial Sequence; identical to SEQ ID NO: 1743
  Synthetic construct

SEQ ID NO: 1745 - protein, 69 aa, Artificial Sequence; identical to SEQ ID NO: 1742
  Synthetic construct

SEQ ID NO: 1746 - protein, 127 aa, Artificial Sequence
  Synthetic construct
EVQLVESGGGLVQPGGSLRLSCVVSGLTFSASEFTWVRQAPGQGLEWLSYIGRGSSAIYYADSVKGRFTVSRDNAKNSLYLQMNSLRVEDTALYYCTRSEKRNTMARKIKGRWFDSWGQGTLVTVAS

SEQ ID NO: 1747 - protein, 127 aa, Artificial Sequence
  Synthetic construct
EVQLVESGGGLVQPGGSLRLSCVVSGLTFSASEFTWVRQAPGQGLEWLSYIGRGSSTIYYADSVKGRFTVSRDNAKNSLYLQMNGLRVEDTALYYCTRSEKRNTMARKIKGRWFDSWGQGTLVTVAS

SEQ ID NO: 1748 - protein, 127 aa, Artificial Sequence; identical to SEQ ID NO: 1743
  Synthetic construct

SEQ ID NO: 1749 - protein, 69 aa, Artificial Sequence; identical to SEQ ID NO: 1742
  Synthetic construct

SEQ ID NO: 1750 - protein, 127 aa, Artificial Sequence
  Synthetic construct
EVQLVESGGGLVQPGGSLRLSCVVSGLTFSASEFTWVRQAPGQGLEWLSYIGRGSSTIYYADSGKGRFTVSRDNAKNSLYLQMNSLRVEDTALYYCTRSEKRNTMARKIKGRWFDSWGQGTLVTVAS

SEQ ID NO: 1751 - protein, 69 aa, Artificial Sequence; identical to SEQ ID NO: 1742
  Synthetic construct

SEQ ID NO: 1752 - protein, 69 aa, Artificial Sequence; identical to SEQ ID NO: 1742
  Synthetic construct

SEQ ID NO: 1753 - protein, 69 aa, Artificial Sequence; identical to SEQ ID NO: 1742
  Synthetic construct

SEQ ID NO: 1754 - protein, 125 aa, Artificial Sequence
  Synthetic construct
EVQLVESGGGLVQPGGSLRLSCEVSGLTFTTSEFNWVRQAPGKGLEWLSFGRGSTIYYADSVKGRFTVSRDNAKSSLYLQMSSLRVEDTALYYCTRSEKRITLALKIKGRWFDPWGQGTLVTVSS

SEQ ID NO: 1755 - protein, 127 aa, Artificial Sequence
  Synthetic construct
EVQLVESGGGLVQPGGSLRLSCVVSGLTFSASEFTWVRQAPGQGLEWLSYIGRGSSTIYYADSVKGRFTVSRDNAKNSLYLQMNSLRVEDTALYYCTRSEKRNTMARKIKGRSFDSWGQGTLVTVAS

SEQ ID NO: 1756 - protein, 125 aa, Artificial Sequence
  Synthetic construct
EVQLVESGGGLVQPGGSLRLSCAVSGLTFSTSEFTWVRQAPGKGLEWLSHGRGSTLYYADSVKGRFTVSRDNAKNSLYLQLSSLRVEDTALYYCTRSEPRNTLARKIKGRWFDPWGQGTLVTVSS

SEQ ID NO: 1757 - DNA, 16 bp, Artificial Sequence
  Synthetic construct
ctagccttccgaacgc

SEQ ID NO: 1758 - DNA, 16 bp, Artificial Sequence
  Synthetic construct
ggatgtttctccaacc

SEQ ID NO: 1759 - DNA, 16 bp, Artificial Sequence
  Synthetic construct
tcacaagcatccaaca

SEQ ID NO: 1760 - DNA, 16 bp, Artificial Sequence
  Synthetic construct
ttgcgtccaggcagta

SEQ ID NO: 1761 - DNA, 16 bp, Artificial Sequence
  Synthetic construct
ggccgatcatgttccc

SEQ ID NO: 1762 - DNA, 16 bp, Artificial Sequence
  Synthetic construct
acatcagtcggcgcta

SEQ ID NO: 1763 - DNA, 379 bp, Artificial Sequence
  Synthetic construct
gaggtgcagctggaagagtcggggggagacttggtaaagccgggggggtccctcagactctcctgtgtagcctcgggatttactttcgacaccgcctggctgaggtgggtccgccaggctcctgggaaggggctggagtgggttggccaaattcaaagtaaaaatgacggtgggacaatcgactacgccgcgcccgtgaaagacagattcaccatctcacgagatgattcaaaagccacggtgtatctgcaaatgaacaatctgaaaacggaagacacagccatttattattgtgccgctgggctctggtccggggacttatcacggcctcgctactctgactcctggggccggggaaccctggtcaccgtctcctcag

SEQ ID NO: 1764 - DNA, 358 bp, Artificial Sequence
  Synthetic construct
gaggtgcacctggtggagtctgggggaggcttgatacagccgggggggtccctgagactctcctgtgcggcctctggattcagcataagtttttatgccatgtactgggtccgccaggctccagggaaggggctggagtgggtcgcagctttcagtggcagtggtgatcgtttatattatgcagactccgggaggggccggttcaccatctcaaaagacatttccaagaacacgctggagctggaaatgaacttcctgggagccgacgacacggccgtatattactgtgctaagggactaactactgaaagcagactagaattttggggccagggaaccctggtcaccgtctcctcag

SEQ ID NO: 1765 - DNA, 364 bp, Artificial Sequence
  Synthetic construct
gaggtgcagctggtggagtctgggggaggcctggtcaagccgggggggtccctcagactctcctgtgcagcctctggattcaccttcagtggctatagcatgagctgggtccgccaggctccagggaaggggctggagtgggtctcatcaattagtactggtagtactaagattgactacgcagactcagtgaagggccgattcaccatctccagagacaacgccaagaactcactgtttctgcaaatggacagcctgagagccgaggacacggctgtgtattactgtgtgtcgtcctggggtccagaaagtccctactattttgactactggggccagggagcccgggtcaccgtctcctcag

SEQ ID NO: 1766 - DNA, 370 bp, Artificial Sequence
  Synthetic construct
cacgtgcagttggtgcagtctggggctgaggtgaagaagcctggggcctccgtgaaggtctcctgcaaggcctctggataccccttcagcgactatgatatcaactgggtgcgacaggcccctggacagggccttgagtggatggggtggatgaaccctgccagtggtaacacagaatatgcacagaaattccagggcagagccaccattacgagggacacctccgtgagcacagcctacttggagctgagcagcctgacatctgacgacgcggccgtttatttctgtgcgagagaatattgtactggtggtgactgtcacttcttcctcgactactggggccagggaaccctggtcactgtctcctcag

SEQ ID NO: 1767 - DNA, 370 bp, Artificial Sequence
  Synthetic construct
caggtgcgactggagcagtctggggctgaggtgatgaagcctggggcctcagtgaaggtttcctgcagggcatctggatactccttcacccccttctatattctctgggtgcgacaggcccctggacaagggcttgagtggatgggaataatcaaccccagtggtggtggaacaacctacgcacagagtttccagggcagagtcaccatgaccagggacaggtccacgaacacagtctacatggaattgaggagcctgagatctgaggacacggccgtttatttctgcgcgcgggtcgcccccccgggagtggtcaataacaagtggttcgacatctggggccagggaaccctggtcaccgtctcctcag

SEQ ID NO: 1768 - DNA, 379 bp, Artificial Sequence
  Synthetic construct
gagggacaggtggtggagtctgggggaggcttggtgcagcctggagggtccctgagactctcctgtgcagtctctgggctcacctttagtacttctgaattcgcctgggtccgccaggctccagggaaggggctggagtggctctcattcattggtcgcgggtcttccatatactacgcagactctgtgaggggccgattcaccgtctccagagacaacgccaagaactcattgtatctacaaatgaacagcctgagagtcgaggacacggctctttattattgcgcgagatcggaaaagcgagttactatgactcggaaaataaagggacggtggttcggcccctggggccagggaaccctggtcaccgtctcctcag

SEQ ID NO: 1769 - DNA, 57 bp, Artificial Sequence
  Synthetic construct
tgtgccgctgggctctggtccggggacttatcacggcctcgctactctgactcctgg

SEQ ID NO: 1770 - DNA, 42 bp, Artificial Sequence
  Synthetic construct
tgtgctaagggactaactactgaaagcagactagaattttgg

SEQ ID NO: 1771 - DNA, 48 bp, Artificial Sequence
  Synthetic construct
tgtgtgtcgtcctggggtccagaaagtccctactattttgactactgg

SEQ ID NO: 1772 - DNA, 54 bp, Artificial Sequence
  Synthetic construct
tgtgcgagagaatattgtactggtggtgactgtcacttcttcctcgactactgg

SEQ ID NO: 1773 - DNA, 54 bp, Artificial Sequence
  Synthetic construct
tgcgcgcgggtcgcccccccgggagtggtcaataacaagtggttcgacatctgg

SEQ ID NO: 1774 - DNA, 66 bp, Artificial Sequence
  Synthetic construct
tgcgcgagatcggaaaagcgagttactatgactcggaaaataaagggacggtggttcggcccctgg

SEQ ID NO: 1775 - DNA, 75 bp, Artificial Sequence
  Synthetic construct
gaggtgcagctggaagagtcggggggagacttggtaaagccgggggggtccctcagactctcctgtgtagcctcg

SEQ ID NO: 1776 - DNA, 75 bp, Artificial Sequence
  Synthetic construct
gaggtgcacctggtggagtctgggggaggcttgatacagccgggggggtccctgagactctcctgtgcggcctct

SEQ ID NO: 1777 - DNA, 75 bp, Artificial Sequence
  Synthetic construct
gaggtgcagctggtggagtctgggggaggcctggtcaagccgggggggtccctcagactctcctgtgcagcctct

SEQ ID NO: 1778 - DNA, 75 bp, Artificial Sequence
  Synthetic construct
cacgtgcagttggtgcagtctggggctgaggtgaagaagcctggggcctccgtgaaggtctcctgcaaggcctct

SEQ ID NO: 1779 - DNA, 75 bp, Artificial Sequence
  Synthetic construct
caggtgcgactggagcagtctggggctgaggtgatgaagcctggggcctcagtgaaggtttcctgcagggcatct

SEQ ID NO: 1780 - DNA, 75 bp, Artificial Sequence
  Synthetic construct
gagggacaggtggtggagtctgggggaggcttggtgcagcctggagggtccctgagactctcctgtgcagtctct

SEQ ID NO: 1781 - DNA, 51 bp, Artificial Sequence
  Synthetic construct
ctgaggtgggtccgccaggctcctgggaaggggctggagtgggttggccaa

SEQ ID NO: 1782 - DNA, 51 bp, Artificial Sequence
  Synthetic construct
atgtactgggtccgccaggctccagggaaggggctggagtgggtcgcagct

SEQ ID NO: 1783 - DNA, 51 bp, Artificial Sequence
  Synthetic construct
atgagctgggtccgccaggctccagggaaggggctggagtgggtctcatca

SEQ ID NO: 1784 - DNA, 51 bp, Artificial Sequence
  Synthetic construct
atcaactgggtgcgacaggcccctggacagggccttgagtggatggggtgg

SEQ ID NO: 1785 - DNA, 51 bp, Artificial Sequence
  Synthetic construct
attctctgggtgcgacaggcccctggacaagggcttgagtggatgggaata

SEQ ID NO: 1786 - DNA, 51 bp, Artificial Sequence
  Synthetic construct
ttcgcctgggtccgccaggctccagggaaggggctggagtggctctcattc

SEQ ID NO: 1787 - DNA, 114 bp, Artificial Sequence
  Synthetic construct
gactacgccgcgcccgtgaaagacagattcaccatctcacgagatgattcaaaagccacggtgtatctgcaaatgaacaatctgaaaacggaagacacagccatttattattgt

SEQ ID NO: 1788 - DNA, 114 bp, Artificial Sequence
  Synthetic construct
tattatgcagactccgggaggggccggttcaccatctcaaaagacatttccaagaacacgctggagctggaaatgaacttcctgggagccgacgacacggccgtatattactgt

SEQ ID NO: 1789 - DNA, 114 bp, Artificial Sequence
  Synthetic construct
gactacgcagactcagtgaagggccgattcaccatctccagagacaacgccaagaactcactgtttctgcaaatggacagcctgagagccgaggacacggctgtgtattactgt

SEQ ID NO: 1790 - DNA, 114 bp, Artificial Sequence
  Synthetic construct
gaatatgcacagaaattccagggcagagccaccattacgagggacacctccgtgagcacagcctacttggagctgagcagcctgacatctgacgacgcggccgtttatttctgt

SEQ ID NO: 1791 - DNA, 114 bp, Artificial Sequence
  Synthetic construct
acctacgcacagagtttccagggcagagtcaccatgaccagggacaggtccacgaacacagtctacatggaattgaggagcctgagatctgaggacacggccgtttatttctgc

SEQ ID NO: 1792 - DNA, 114 bp, Artificial Sequence
  Synthetic construct
tactacgcagactctgtgaggggccgattcaccgtctccagagacaacgccaagaactcattgtatctacaaatgaacagcctgagagtcgaggacacggctctttattattgc

SEQ ID NO: 1793 - DNA, 34 bp, Artificial Sequence
  Synthetic construct
tggggccggggaaccctggtcaccgtctcctcag

SEQ ID NO: 1794 - DNA, 34 bp, Artificial Sequence
  Synthetic construct
tggggccagggaaccctggtcaccgtctcctcag

SEQ ID NO: 1795 - DNA, 34 bp, Artificial Sequence
  Synthetic construct
tggggccagggagcccgggtcaccgtctcctcag

SEQ ID NO: 1796 - DNA, 34 bp, Artificial Sequence
  Synthetic construct
tggggccagggaaccctggtcactgtctcctcag

SEQ ID NO: 1797 - DNA, 34 bp, Artificial Sequence; identical to SEQ ID NO: 1794
  Synthetic construct

SEQ ID NO: 1798 - DNA, 34 bp, Artificial Sequence; identical to SEQ ID NO: 1794
  Synthetic construct

SEQ ID NO: 1799 - DNA, 24 bp, Artificial Sequence
  Synthetic construct
ggatttactttcgacaccgcctgg

SEQ ID NO: 1800 - DNA, 24 bp, Artificial Sequence
  Synthetic construct
ggattcagcataagtttttatgcc

SEQ ID NO: 1801 - DNA, 24 bp, Artificial Sequence
  Synthetic construct
ggattcaccttcagtggctatagc

SEQ ID NO: 1802 - DNA, 24 bp, Artificial Sequence
  Synthetic construct
ggataccccttcagcgactatgat

SEQ ID NO: 1803 - DNA, 24 bp, Artificial Sequence
  Synthetic construct
ggatactccttcacccccttctat

SEQ ID NO: 1804 - DNA, 24 bp, Artificial Sequence
  Synthetic construct
gggctcacctttagtacttctgaa

SEQ ID NO: 1805 - DNA, 30 bp, Artificial Sequence
  Synthetic construct
attcaaagtaaaaatgacggtgggacaatc

SEQ ID NO: 1806 - DNA, 24 bp, Artificial Sequence
  Synthetic construct
ttcagtggcagtggtgatcgttta

SEQ ID NO: 1807 - DNA, 24 bp, Artificial Sequence
  Synthetic construct
attagtactggtagtactaagatt

SEQ ID NO: 1808 - DNA, 24 bp, Artificial Sequence
  Synthetic construct
atgaaccctgccagtggtaacaca

SEQ ID NO: 1809 - DNA, 24 bp, Artificial Sequence
  Synthetic construct
atcaaccccagtggtggtggaaca

SEQ ID NO: 1810 - DNA, 21 bp, Artificial Sequence
  Synthetic construct
attggtcgcgggtcttccata

SEQ ID NO: 1811 - DNA, 51 bp, Artificial Sequence
  Synthetic construct
gccgctgggctctggtccggggacttatcacggcctcgctactctgactcc

SEQ ID NO: 1812 - DNA, 36 bp, Artificial Sequence
  Synthetic construct
gctaagggactaactactgaaagcagactagaattt

SEQ ID NO: 1813 - DNA, 42 bp, Artificial Sequence
  Synthetic construct
gtgtcgtcctggggtccagaaagtccctactattttgactac

SEQ ID NO: 1814 - DNA, 48 bp, Artificial Sequence
  Synthetic construct
gcgagagaatattgtactggtggtgactgtcacttcttcctcgactac

SEQ ID NO: 1815 - DNA, 48 bp, Artificial Sequence
  Synthetic construct
gcgcgggtcgcccccccgggagtggtcaataacaagtggttcgacatc

SEQ ID NO: 1816 - DNA, 60 bp, Artificial Sequence
  Synthetic construct
gcgagatcggaaaagcgagttactatgactcggaaaataaagggacggtggttcggcccc

SEQ ID NO: 1817 - protein, 19 aa, Artificial Sequence
  Synthetic construct
CAAGLWSGDLSRPRYSDSW

SEQ ID NO: 1818 - protein, 14 aa, Artificial Sequence
  Synthetic construct
CAKGLTTESRLEFW

SEQ ID NO: 1819 - protein, 16 aa, Artificial Sequence
  Synthetic construct
CVSSWGPESPYYFDYW

SEQ ID NO: 1820 - protein, 18 aa, Artificial Sequence
  Synthetic construct
CAREYCTGGDCHFFLDYW

SEQ ID NO: 1821 - protein, 18 aa, Artificial Sequence
  Synthetic construct
CARVAPPGVVNNKWFDIW

SEQ ID NO: 1822 - protein, 22 aa, Artificial Sequence
  Synthetic construct
CARSEKRVTMTRKIKGRWFGPW

SEQ ID NO: 1823 - DNA, 57 bp, Artificial Sequence; identical to SEQ ID NO: 1769
  Synthetic construct

SEQ ID NO: 1824 - DNA, 42 bp, Artificial Sequence; identical to SEQ ID NO: 1770
  Synthetic construct

SEQ ID NO: 1825 - DNA, 48 bp, Artificial Sequence; identical to SEQ ID NO: 1771
  Synthetic construct

SEQ ID NO: 1826 - DNA, 54 bp, Artificial Sequence; identical to SEQ ID NO: 1772
  Synthetic construct

SEQ ID NO: 1827 - DNA, 54 bp, Artificial Sequence; identical to SEQ ID NO: 1773
  Synthetic construct

SEQ ID NO: 1828 - DNA, 66 bp, Artificial Sequence; identical to SEQ ID NO: 1774
  Synthetic construct

SEQ ID NO: 1829 - DNA, 337 bp, Artificial Sequence
  Synthetic construct
gatattgtgctgactcagtctccactctccctgtccgtcacccctggagagccggcctccatctcctgcaggtctaatcagagcctcctccataataatggatacaactttttggattggtacctgcagaagccagggcagtctccacagctcctgatctatttggcttcttctcgggcctccggggtccctgacaggttcagtggcagtggatcaggcacagattttacactgagaatcagcagagtggaggctgaggatgttggggtctattactgcatgcaacctctacagctcccagacactttcggcggagggaccaaggtggagatcaaac

SEQ ID NO: 1830 - DNA, 319 bp, Artificial Sequence
  Synthetic construct
gacatccagatgacccagtctccatcctccctgtctgcatctgtcggagacagagtcaccatcacctgccgggcaagtcaatacattggcagttttttaaattggtatcagcaacaacccggaaaaccccctaaactcctcatctatgctgcgtccactttgcaatctggggcccccctgagattcagtgccagtgagtccgggtcagatttcactctcaccatcaccaatctgcagcctgaagactttgccacttattactgtcaacagagttacaatgtcccgacgttcggccaggggaccaaggtggagatcaagc

SEQ ID NO: 1831 - DNA, 322 bp, Artificial Sequence
  Synthetic construct
gaagttgtgctgactcagtctccagactttcagtctgtgactccaaaggagaaagtcaccatcatctgccgggccagtcagagcattggtagttacttacactggtaccagcagaaaccacatcagtctccaaaactcctcatcaaatatgcttcccagtccatctcaggggtcccctcgaggttcagtggcagtggctctgggacagaattcaccctcaccatcaagagcctggaagctgaagatgctgcaacgtattactgtcatcagagtagtagtttacctttcactttcggccctgggacgaaagtggatatcaaac

SEQ ID NO: 1832 - DNA, 340 bp, Artificial Sequence
  Synthetic construct
gacatcgtgatgacccagtctccagactccctgcctgtgtctctgggcgagagggccaccatcaactgcaagtccagtcagagtgttttatacacccccaacaacaagaattacttagcttggtatcagcagaagccaggacagcctccgaagctgctcatttactgggcatctatccgtcaatccggggtccctgagcgattcagtggcagcgggtcagggacagatttcactctcaccatcagcagcctgcaggctgaggatgtggcggtttattattgtcaacatttttatagtagtcctccgactttcggccgtgggaccactgtggcgatcaaac

SEQ ID NO: 1833 - DNA, 331 bp, Artificial Sequence
  Synthetic construct
cagtctgccctgactcagccgcgctcagtgtccgggtctcctggacagtcagtcaccatctcctgcactggaaccagcacttatgtcgatgcttttacctatgtctcctggtaccagcaacacccaggcagagcccccaaagtcttgatttatgatgtcaataagcggccctcaggggtccctgatcgcttctctggctccaagtctggcagtacgacctccctgaccatctctgatctccacattgaagatgaggctgattattactgctgcttgtatgcaggatcctacagttgggtcttcggcggagggaccaagctgaccgtcctgg

SEQ ID NO: 1834 - DNA, 325 bp, Artificial Sequence
  Synthetic construct
tcctatgtgctgactcagccaccctcggtgtcagtggccccagggcagacggccaggattacttgtgggggagactactttgaagttaaaagtgttcactggtaccagcagaagccaggccaggcccctgtattggtcgcctttgatgataccgaccggccctcagggatccctgaccgattctctggctccacctctgggaacacggccaccctgacaatcagtagggtcgaagtcggggatgaggccgactattattgtcaggtgtgggatagtagtagtgaacatgtggtcttcggcggagggagcaagttgaccgtcctag

SEQ ID NO: 1835 - DNA, 33 bp, Artificial Sequence
  Synthetic construct
tgcatgcaacctctacagctcccagacactttc

SEQ ID NO: 1836 - DNA, 30 bp, Artificial Sequence
  Synthetic construct
tgtcaacagagttacaatgtcccgacgttc

SEQ ID NO: 1837 - DNA, 33 bp, Artificial Sequence
  Synthetic construct
tgtcatcagagtagtagtttacctttcactttc

SEQ ID NO: 1838 - DNA, 33 bp, Artificial Sequence
  Synthetic construct
tgtcaacatttttatagtagtcctccgactttc

SEQ ID NO: 1839 - DNA, 36 bp, Artificial Sequence
  Synthetic construct
tgctgcttgtatgcaggatcctacagttgggtcttc

SEQ ID NO: 1840 - DNA, 39 bp, Artificial Sequence
  Synthetic construct
tgtcaggtgtgggatagtagtagtgaacatgtggtcttc

SEQ ID NO: 1841 - DNA, 78 bp, Artificial Sequence
  Synthetic construct
gatattgtgctgactcagtctccactctccctgtccgtcacccctggagagccggcctccatctcctgcaggtctaat

SEQ ID NO: 1842 - DNA, 78 bp, Artificial Sequence
  Synthetic construct
gacatccagatgacccagtctccatcctccctgtctgcatctgtcggagacagagtcaccatcacctgccgggcaagt

SEQ ID NO: 1843 - DNA, 78 bp, Artificial Sequence
  Synthetic construct
gaagttgtgctgactcagtctccagactttcagtctgtgactccaaaggagaaagtcaccatcatctgccgggccagt

SEQ ID NO: 1844 - DNA, 78 bp, Artificial Sequence
  Synthetic construct
gacatcgtgatgacccagtctccagactccctgcctgtgtctctgggcgagagggccaccatcaactgcaagtccagt

SEQ ID NO: 1845 - DNA, 75 bp, Artificial Sequence
  Synthetic construct
cagtctgccctgactcagccgcgctcagtgtccgggtctcctggacagtcagtcaccatctcctgcactggaacc

SEQ ID NO: 1846 - DNA, 75 bp, Artificial Sequence
  Synthetic construct
tcctatgtgctgactcagccaccctcggtgtcagtggccccagggcagacggccaggattacttgtgggggagac

SEQ ID NO: 1847 - DNA, 51 bp, Artificial Sequence
  Synthetic construct
ttggattggtacctgcagaagccagggcagtctccacagctcctgatctat

SEQ ID NO: 1848 - DNA, 51 bp, Artificial Sequence
  Synthetic construct
ttaaattggtatcagcaacaacccggaaaaccccctaaactcctcatctat

SEQ ID NO: 1849 - DNA, 51 bp, Artificial Sequence
  Synthetic construct
ttacactggtaccagcagaaaccacatcagtctccaaaactcctcatcaaa

SEQ ID NO: 1850 - DNA, 51 bp, Artificial Sequence
  Synthetic construct
ttagcttggtatcagcagaagccaggacagcctccgaagctgctcatttac

SEQ ID NO: 1851 - DNA, 51 bp, Artificial Sequence
  Synthetic construct
gtctcctggtaccagcaacacccaggcagagcccccaaagtcttgatttat

SEQ ID NO: 1852 - DNA, 51 bp, Artificial Sequence
  Synthetic construct
gttcactggtaccagcagaagccaggccaggcccctgtattggtcgccttt

SEQ ID NO: 1853 - DNA, 108 bp, Artificial Sequence
  Synthetic construct
tctcgggcctccggggtccctgacaggttcagtggcagtggatcaggcacagattttacactgagaatcagcagagtggaggctgaggatgttggggtctattactgc

SEQ ID NO: 1854 - DNA, 108 bp, Artificial Sequence
  Synthetic construct
actttgcaatctggggcccccctgagattcagtgccagtgagtccgggtcagatttcactctcaccatcaccaatctgcagcctgaagactttgccacttattactgt

SEQ ID NO: 1855 - DNA, 108 bp, Artificial Sequence
  Synthetic construct
cagtccatctcaggggtcccctcgaggttcagtggcagtggctctgggacagaattcaccctcaccatcaagagcctggaagctgaagatgctgcaacgtattactgt

SEQ ID NO: 1856 - DNA, 108 bp, Artificial Sequence
  Synthetic construct
atccgtcaatccggggtccctgagcgattcagtggcagcgggtcagggacagatttcactctcaccatcagcagcctgcaggctgaggatgtggcggtttattattgt

SEQ ID NO: 1857 - DNA, 108 bp, Artificial Sequence
  Synthetic construct
aagcggccctcaggggtccctgatcgcttctctggctccaagtctggcagtacgacctccctgaccatctctgatctccacattgaagatgaggctgattattactgc

SEQ ID NO: 1858 - DNA, 108 bp, Artificial Sequence
  Synthetic construct
gaccggccctcagggatccctgaccgattctctggctccacctctgggaacacggccaccctgacaatcagtagggtcgaagtcggggatgaggccgactattattgt

SEQ ID NO: 1859 - DNA, 31 bp, Artificial Sequence
  Synthetic construct
ttcggcggagggaccaaggtggagatcaaac

SEQ ID NO: 1860 - DNA, 31 bp, Artificial Sequence
  Synthetic construct
ttcggccaggggaccaaggtggagatcaagc

SEQ ID NO: 1861 - DNA, 31 bp, Artificial Sequence
  Synthetic construct
ttcggccctgggacgaaagtggatatcaaac

SEQ ID NO: 1862 - DNA, 31 bp, Artificial Sequence
  Synthetic construct
ttcggccgtgggaccactgtggcgatcaaac

SEQ ID NO: 1863 - DNA, 31 bp, Artificial Sequence
  Synthetic construct
ttcggcggagggaccaagctgaccgtcctgg

SEQ ID NO: 1864 - DNA, 31 bp, Artificial Sequence
  Synthetic construct
ttcggcggagggagcaagttgaccgtcctag

SEQ ID NO: 1865 - DNA, 33 bp, Artificial Sequence
  Synthetic construct
cagagcctcctccataataatggatacaacttt

SEQ ID NO: 1866 - DNA, 18 bp, Artificial Sequence
  Synthetic construct
caatacattggcagtttt

SEQ ID NO: 1867 - DNA, 18 bp, Artificial Sequence
  Synthetic construct
cagagcattggtagttac

SEQ ID NO: 1868 - DNA, 36 bp, Artificial Sequence
  Synthetic construct
cagagtgttttatacacccccaacaacaagaattac

SEQ ID NO: 1869 - DNA, 27 bp, Artificial Sequence
  Synthetic construct
agcacttatgtcgatgcttttacctat

SEQ ID NO: 1870 - DNA, 18 bp, Artificial Sequence
  Synthetic construct
tactttgaagttaaaagt

SEQ ID NO: 1871 - DNA, 9 bp, Artificial Sequence
  Synthetic construct
ttggcttct

SEQ ID NO: 1872 - DNA, 9 bp, Artificial Sequence
  Synthetic construct
gctgcgtcc

SEQ ID NO: 1873 - DNA, 9 bp, Artificial Sequence
  Synthetic construct
tatgcttcc

SEQ ID NO: 1874 - DNA, 9 bp, Artificial Sequence
  Synthetic construct
tgggcatct

SEQ ID NO: 1875 - DNA, 9 bp, Artificial Sequence
  Synthetic construct
gatgtcaat

SEQ ID NO: 1876 - DNA, 9 bp, Artificial Sequence
  Synthetic construct
gatgatacc

SEQ ID NO: 1877 - DNA, 27 bp, Artificial Sequence
  Synthetic construct
atgcaacctctacagctcccagacact

SEQ ID NO: 1878 - DNA, 24 bp, Artificial Sequence
  Synthetic construct
caacagagttacaatgtcccgacg

SEQ ID NO: 1879 - DNA, 27 bp, Artificial Sequence
  Synthetic construct
catcagagtagtagtttacctttcact

SEQ ID NO: 1880 - DNA, 27 bp, Artificial Sequence
  Synthetic construct
caacatttttatagtagtcctccgact

SEQ ID NO: 1881 - DNA, 30 bp, Artificial Sequence
  Synthetic construct
tgcttgtatgcaggatcctacagttgggtc

SEQ ID NO: 1882 - DNA, 33 bp, Artificial Sequence
  Synthetic construct
caggtgtgggatagtagtagtgaacatgtggtc

SEQ ID NO: 1883 - protein, 11 aa, Artificial Sequence
  Synthetic construct
CMQPLQLPDTF

SEQ ID NO: 1884 - protein, 10 aa, Artificial Sequence
  Synthetic construct
CQQSYNVPTF

SEQ ID NO: 1885 - protein, 11 aa, Artificial Sequence [sequence omitted]

SEQ ID NO: 1886 - protein, 11 aa, Artificial Sequence
  Synthetic construct
CQHFYSSPPTF

SEQ ID NO: 1887 - protein, 12 aa, Artificial Sequence
  Synthetic construct
CCLYAGSYSWVF

SEQ ID NO: 1888 - protein, 13 aa, Artificial Sequence [sequence omitted]

SEQ ID NO: 1889 - DNA, 33 bp, Artificial Sequence; identical to SEQ ID NO: 1835
  Synthetic construct

SEQ ID NO: 1890 - DNA, 30 bp, Artificial Sequence; identical to SEQ ID NO: 1836
  Synthetic construct

SEQ ID NO: 1891 - DNA, 33 bp, Artificial Sequence; identical to SEQ ID NO: 1837
  Synthetic construct

SEQ ID NO: 1892 - DNA, 33 bp, Artificial Sequence; identical to SEQ ID NO: 1838
  Synthetic construct

SEQ ID NO: 1893 - DNA, 36 bp, Artificial Sequence; identical to SEQ ID NO: 1839
  Synthetic construct

SEQ ID NO: 1894 - DNA, 39 bp, Artificial Sequence; identical to SEQ ID NO: 1840
  Synthetic construct

SEQ ID NO: 1895 - protein, 126 aa, Artificial Sequence
  Synthetic construct
EVQLEESGGDLVKPGGSLRLSCVASGFTFDTAWLRWVRQAPGKGLEWVGQIQSKNDGGTIDYAAPVKDRFTISRDDSKATVYLQMNNLKTEDTAIYYCAAGLWSGDLSRPRYSDSWGRGTLVTVSS

SEQ ID NO: 1896 - protein, 119 aa, Artificial Sequence
  Synthetic construct
EVHLVESGGGLIQPGGSLRLSCAASGFSISFYAMYWVRQAPGKGLEWVAAFSGSGDRLYYADSGRGRFTISKDISKNTLELEMNFLGADDTAVYYCAKGLTTESRLEFWGQGTLVTVSS

SEQ ID NO: 1897 - protein, 121 aa, Artificial Sequence
  Synthetic construct
EVQLVESGGGLVKPGGSLRLSCAASGFTFSGYSMSWVRQAPGKGLEWVSSISTGSTKIDYADSVKGRFTISRDNAKNSLFLQMDSLRAEDTAVYYCVSSWGPESPYYFDYWGQGARVTVSS

SEQ ID NO: 1898 - protein, 123 aa, Artificial Sequence
  Synthetic construct
HVQLVQSGAEVKKPGASVKVSCKASGYPFSDYDINWVRQAPGQGLEWMGWMNPASGNTEYAQKFQGRATITRDTSVSTAYLELSSLTSDDAAVYFCAREYCTGGDCHFFLDYWGQGTLVTVSS

SEQ ID NO: 1899 - protein, 112 aa, Artificial Sequence; identical to SEQ ID NO: 119
  Synthetic construct

SEQ ID NO: 1900 - protein, 106 aa, Artificial Sequence
  Synthetic construct
DIQMTQSPSSLSASVGDRVTITCRASQYIGSFLNWYQQQPGKPPKLLIYAASTLQSGAPLRFSASESGSDFTLTITNLQPEDFATYYCQQSYNVPTFGQGTKVEIK

SEQ ID NO: 1901 - protein, 107 aa, Artificial Sequence; identical to SEQ ID NO: 242
  Synthetic construct

SEQ ID NO: 1902 - protein, 113 aa, Artificial Sequence
  Synthetic construct
DIVMTQSPDSLPVSLGERATINCKSSQSVLYTPNNKNYLAWYQQKPGQPPKLLIYWASIRQSGVPERFSGSGSGTDFTLTISSLQAEDVAVYYCQHFYSSPPTFGRGTTVAIK

SEQ ID NO: 1903 - protein, 110 aa, Artificial Sequence
  Synthetic construct
QSALTQPRSVSGSPGQSVTISCTGTSTYVDAFTYVSWYQQHPGRAPKVLIYDVNKRPSGVPDRFSGSKSGSTTSLTISDLHIEDEADYYCCLYAGSYSWVFGGGTKLTVL

SEQ ID NO: 1904 - protein, 108 aa, Artificial Sequence; identical to SEQ ID NO: 1406
  Synthetic construct

SEQ ID NO: 1905 - DNA, 16 bp, Artificial Sequence
  Synthetic construct
ataagagtcggaggta

SEQ ID NO: 1906 - DNA, 16 bp, Artificial Sequence
  Synthetic construct
cttggctagctgaaat

SEQ ID NO: 1907 - DNA, 16 bp, Artificial Sequence
  Synthetic construct
tagccggtcacaggcc

SEQ ID NO: 1908 - DNA, 16 bp, Artificial Sequence
  Synthetic construct
agtctttagtaggtgc

SEQ ID NO: 1909 - DNA, 16 bp, Artificial Sequence
  Synthetic construct
gtcctcacagagtgtg

SEQ ID NO: 1910 - DNA, 16 bp, Artificial Sequence
  Synthetic construct
cgttagaagcgatgac

SEQ ID NO: 1911 - DNA, 16 bp, Artificial Sequence
  Synthetic construct
aatccagagtggtccc

SEQ ID NO: 1912 - DNA, 16 bp, Artificial Sequence
  Synthetic construct
tcaggtagtaacgacg

SEQ ID NO: 1913 - DNA, 16 bp, Artificial Sequence
  Synthetic construct
ccatgtcgttctgttt

SEQ ID NO: 1914 - DNA, 16 bp, Artificial Sequence
  Synthetic construct
cacaaactcaaggtaa

SEQ ID NO: 1915 - DNA, 16 bp, Artificial Sequence
  Synthetic construct
tgtattcgtctctctg

SEQ ID NO: 1916 - DNA, 16 bp, Artificial Sequence
  Synthetic construct
ctgatagagcctatgt

SEQ ID NO: 1917 - DNA, 16 bp, Artificial Sequence
  Synthetic construct
cgtgagcgtggaaaga

SEQ ID NO: 1918 - DNA, 16 bp, Artificial Sequence
  Synthetic construct
tcaacgacaagttaag

SEQ ID NO: 1919 - DNA, 16 bp, Artificial Sequence
  Synthetic construct
cccatacagcgaaggg

SEQ ID NO: 1920 - DNA, 16 bp, Artificial Sequence
  Synthetic construct
cgtgagcgttatgcgt

SEQ ID NO: 1921 - DNA, 16 bp, Artificial Sequence
  Synthetic construct
gcctctagtgccttgg

SEQ ID NO: 1922 - DNA, 16 bp, Artificial Sequence
  Synthetic construct
tcttcggcacagcgtc

SEQ ID NO: 1923 - DNA, 16 bp, Artificial Sequence
  Synthetic construct
cgtgtaacatcagtca

SEQ ID NO: 1924 - DNA, 16 bp, Artificial Sequence
  Synthetic construct
atagacccattacgac

SEQ ID NO: 1925 - DNA, 16 bp, Artificial Sequence
  Synthetic construct
ccttacggtggtgtag

SEQ ID NO: 1926 - DNA, 16 bp, Artificial Sequence
  Synthetic construct
attggacgtagaggaa

SEQ ID NO: 1927 - DNA, 16 bp, Artificial Sequence
  Synthetic construct
agattgcagagtcggt

SEQ ID NO: 1928 - DNA, 16 bp, Artificial Sequence
  Synthetic construct
gaaatgatcttgggta

SEQ ID NO: 1929 - DNA, 16 bp, Artificial Sequence
  Synthetic construct
cgctggatcgcggatc

SEQ ID NO: 1930 - DNA, 16 bp, Artificial Sequence
  Synthetic construct
cattcgctccgttgct

SEQ ID NO: 1931 - DNA, 16 bp, Artificial Sequence
  Synthetic construct
gagcagacatcgtcgg

SEQ ID NO: 1932 - DNA, 16 bp, Artificial Sequence
  Synthetic construct
aaatgccgtcgaatct

SEQ ID NO: 1933 - DNA, 16 bp, Artificial Sequence
  Synthetic construct
catattcaggagttta

SEQ ID NO: 1934 - DNA, 16 bp, Artificial Sequence
  Synthetic construct
atgtgtgtccatgagt

SEQ ID NO: 1935 - DNA, 16 bp, Artificial Sequence
  Synthetic construct
aacgttgtctgaaaga

SEQ ID NO: 1936 - DNA, 16 bp, Artificial Sequence
  Synthetic construct
ataagagcacgaaata

SEQ ID NO: 1937 - DNA, 16 bp, Artificial Sequence
  Synthetic construct
ccacctaagtagtgcg

SEQ ID NO: 1938 - DNA, 16 bp, Artificial Sequence
  Synthetic construct
tgctaccgtctgatca

SEQ ID NO: 1939 - DNA, 16 bp, Artificial Sequence
  Synthetic construct
gctgcagcacaggagt

SEQ ID NO: 1940 - DNA, 16 bp, Artificial Sequence
  Synthetic construct
tatcaggagtacgccc

SEQ ID NO: 1941 - DNA, 16 bp, Artificial Sequence
  Synthetic construct
aatcggtcatagaaac

SEQ ID NO: 1942 - DNA, 16 bp, Artificial Sequence
  Synthetic construct
ggacaagcacgaagca

SEQ ID NO: 1943 - DNA, 16 bp, Artificial Sequence
  Synthetic construct
aggccactcggtctaa

SEQ ID NO: 1944 - DNA, 16 bp, Artificial Sequence
  Synthetic construct
aggtcatagatatgca

SEQ ID NO: 1945 - DNA, 16 bp, Artificial Sequence
  Synthetic construct
gccaaatcaatagcaa

SEQ ID NO: 1946 - DNA, 16 bp, Artificial Sequence
  Synthetic construct
aaccatgtcagtccct

SEQ ID NO: 1947 - DNA, 16 bp, Artificial Sequence
  Synthetic construct
tatcaggcatacgcta

SEQ ID NO: 1948 - DNA, 16 bp, Artificial Sequence
  Synthetic construct
acactgacatgcctaa

SEQ ID NO: 1949 - DNA, 16 bp, Artificial Sequence
  Synthetic construct
ttgcgtccaggcagta

SEQ ID NO: 1950 - DNA, 16 bp, Artificial Sequence
  Synthetic construct
caccagggtgtctgat

SEQ ID NO: 1951 - DNA, 16 bp, Artificial Sequence
  Synthetic construct
aagccgccaggtctcg

SEQ ID NO: 1952 - DNA, 16 bp, Artificial Sequence
  Synthetic construct
catgcctgtctgcaat

SEQ ID NO: 1953 - DNA, 16 bp, Artificial Sequence
  Synthetic construct
aaacgggaggccctca

SEQ ID NO: 1954 - DNA, 16 bp, Artificial Sequence
  Synthetic construct
catcaagtccaatggt

SEQ ID NO: 1955 - DNA, 16 bp, Artificial Sequence
  Synthetic construct
ggacatttcctagtga

SEQ ID NO: 1956 - DNA, 16 bp, Artificial Sequence
  Synthetic construct
gagcagaagaacaatc

SEQ ID NO: 1957 - DNA, 16 bp, Artificial Sequence
  Synthetic construct
gactgcgcaaggttct

SEQ ID NO: 1958 - DNA, 16 bp, Artificial Sequence
  Synthetic construct
cctagctgtactcgcg

SEQ ID NO: 1959 - DNA, 16 bp, Artificial Sequence
  Synthetic construct
catatgggtcgagttt

SEQ ID NO: 1960 - DNA, 16 bp, Artificial Sequence
  Synthetic construct
gcgcgatagatcgata

SEQ ID NO: 1961 - DNA, 16 bp, Artificial Sequence
  Synthetic construct
tgagcatagaggtaga

SEQ ID NO: 1962 - DNA, 16 bp, Artificial Sequence
  Synthetic construct
tttatgccatgtctcc

SEQ ID NO: 1963 - DNA, 16 bp, Artificial Sequence
  Synthetic construct
gtatcttagagcccaa

SEQ ID NO: 1964 - DNA, 16 bp, Artificial Sequence
  Synthetic construct
ctgtttagttgtggag

SEQ ID NO: 1965 - DNA, 16 bp, Artificial Sequence
  Synthetic construct
atcatggtcagtgttg

SEQ ID NO: 1966 - DNA, 16 bp, Artificial Sequence
  Synthetic construct
tagttggcaagctgtt

SEQ ID NO: 1967 - DNA, 16 bp, Artificial Sequence
  Synthetic construct
cctttctgtcacttcc

SEQ ID NO: 1968 - DNA, 16 bp, Artificial Sequence
  Synthetic construct
cgattgaagaataggg

SEQ ID NO: 1969 - DNA, 16 bp, Artificial Sequence
  Synthetic construct
ccgtggatctgtcaag

SEQ ID NO: 1970 - DNA, 16 bp, Artificial Sequence
  Synthetic construct
tatgcccgtgagtata

SEQ ID NO: 1971 - DNA, 16 bp, Artificial Sequence
  Synthetic construct
cgtgtaaagtcatcca

SEQ ID NO: 1972 - DNA, 16 bp, Artificial Sequence
  Synthetic construct
catggcggttcgttga

SEQ ID NO: 1973 - DNA, 16 bp, Artificial Sequence
  Synthetic construct
agcagcctcggccgat

SEQ ID NO: 1974 - DNA, 16 bp, Artificial Sequence
  Synthetic construct
gcttgaaagatcgggt

SEQ ID NO: 1975 - DNA, 16 bp, Artificial Sequence
  Synthetic construct
ctctacgagctcaact

SEQ ID NO: 1976 - DNA, 16 bp, Artificial Sequence
  Synthetic construct
aggccacgtaaacctc

SEQ ID NO: 1977 - DNA, 16 bp, Artificial Sequence
  Synthetic construct
gggttgcagtacgata

SEQ ID NO: 1978 - DNA, 16 bp, Artificial Sequence
  Synthetic construct
cttaccgcagtacact

SEQ ID NO: 1979 - DNA, 16 bp, Artificial Sequence
  Synthetic construct
ccttcgacatacgccg

SEQ ID NO: 1980 - DNA, 16 bp, Artificial Sequence
  Synthetic construct
cagtaacagaataggg

SEQ ID NO: 1981 - DNA, 16 bp, Artificial Sequence
  Synthetic construct
atgagggtcaacgcta

SEQ ID NO: 1982 - DNA, 16 bp, Artificial Sequence
  Synthetic construct
agacgttgtcgaacag

SEQ ID NO: 1983 - DNA, 16 bp, Artificial Sequence
  Synthetic construct
ttctcaatcgcaggct

SEQ ID NO: 1984 - DNA, 16 bp, Artificial Sequence
  Synthetic construct
ccctcctaggatgtat

SEQ ID NO: 1985 - DNA, 16 bp, Artificial Sequence
  Synthetic construct
cgctatcgtaaatgtg

SEQ ID NO: 1986 - DNA, 16 bp, Artificial Sequence
  Synthetic construct
tcagctctcgctagcg

SEQ ID NO: 1987 - DNA, 16 bp, Artificial Sequence
  Synthetic construct
gctctgtgtgcaccac

SEQ ID NO: 1988 - DNA, 16 bp, Artificial Sequence
  Synthetic construct
acaccgggtcgtcttc

SEQ ID NO: 1989 - DNA, 16 bp, Artificial Sequence
  Synthetic construct
ctgaaacaggtgttaa

SEQ ID NO: 1990 - DNA, 16 bp, Artificial Sequence
  Synthetic construct
gtgcttctctcggacg

SEQ ID NO: 1991 - DNA, 16 bp, Artificial Sequence
  Synthetic construct
ggaacttagggatctg

SEQ ID NO: 1992 - DNA, 16 bp, Artificial Sequence
  Synthetic construct
gggcacttcgccataa

SEQ ID NO: 1993 - DNA, 16 bp, Artificial Sequence
  Synthetic construct
acgccgaagaaaccgc

SEQ ID NO: 1994 - DNA, 16 bp, Artificial Sequence
  Synthetic construct
cagatcacacctatcc

SEQ ID NO: 1995 - DNA, 16 bp, Artificial Sequence
  Synthetic construct
ccggtagtctaactct

SEQ ID NO: 1996 - DNA, 16 bp, Artificial Sequence
  Synthetic construct
ttcgaagtcccaagat

SEQ ID NO: 1997 - DNA, 16 bp, Artificial Sequence
  Synthetic construct
gtcgggtgtaatcacc

SEQ ID NO: 1998 - DNA, 16 bp, Artificial Sequence
  Synthetic construct
cgattgaagattaccc

SEQ ID NO: 1999 - DNA, 16 bp, Artificial Sequence
  Synthetic construct
gcatgtaagcttatcg

SEQ ID NO: 2000 - DNA, 16 bp, Artificial Sequence
  Synthetic construct
agcggtctccacgtgg

SEQ ID NO: 2001 - DNA, 16 bp, Artificial Sequence
  Synthetic construct
tactcgccaatagagt

SEQ ID NO: 2002 - DNA, 16 bp, Artificial Sequence
  Synthetic construct
cgggtcatccaaacac

SEQ ID NO: 2003 - DNA, 16 bp, Artificial Sequence
  Synthetic construct
aaagtagagtcccacg

SEQ ID NO: 2004 - DNA, 16 bp, Artificial Sequence
  Synthetic construct
gttcattagtgactct

SEQ ID NO: 2005 - DNA, 16 bp, Artificial Sequence
  Synthetic construct
ctcggaggtaacgcga

SEQ ID NO: 2006 - DNA, 16 bp, Artificial Sequence
  Synthetic construct
aggccacgtcgaacag

SEQ ID NO: 2007 - DNA, 16 bp, Artificial Sequence
  Synthetic construct
ccaatccagttcgcat

SEQ ID NO: 2008 - DNA, 16 bp, Artificial Sequence
  Synthetic construct
gtcacaatcgtggacc

SEQ ID NO: 2009 - DNA, 16 bp, Artificial Sequence
  Synthetic construct
tggttagagtttcctt

SEQ ID NO: 2010 - DNA, 16 bp, Artificial Sequence
  Synthetic construct
agagcgatctacttac

SEQ ID NO: 2011 - DNA, 16 bp, Artificial Sequence
  Synthetic construct
tggcgcacataccatg

SEQ ID NO: 2012 - DNA, 16 bp, Artificial Sequence
  Synthetic construct
acggagatcattatcc

SEQ ID NO: 2013 - DNA, 16 bp, Artificial Sequence
  Synthetic construct
cagccgacagtgagtg

SEQ ID NO: 2014 - DNA, 16 bp, Artificial Sequence
  Synthetic construct
ctgaagtcaagcgagt

SEQ ID NO: 2015 - DNA, 16 bp, Artificial Sequence
  Synthetic construct
ctgtgcttcgggagta

SEQ ID NO: 2016 - DNA, 16 bp, Artificial Sequence
  Synthetic construct
gtcacaacaagtagta

SEQ ID NO: 2017 - DNA, 16 bp, Artificial Sequence
  Synthetic construct
taaaccggttccacaa

SEQ ID NO: 2018 - DNA, 16 bp, Artificial Sequence
  Synthetic construct
taaaccgtcacctcgt

SEQ ID NO: 2019 - DNA, 16 bp, Artificial Sequence
  Synthetic construct
tacttacagagtcggt

SEQ ID NO: 2020 - DNA, 16 bp, Artificial Sequence
  Synthetic construct
agattgctcgcggatc

SEQ ID NO: 2021 - DNA, 16 bp, Artificial Sequence
  Synthetic construct
gctcctatcttcatgt

SEQ ID NO: 2022 - DNA, 16 bp, Artificial Sequence
  Synthetic construct
tacctattctggagcc

SEQ ID NO: 2023 - DNA, 16 bp, Artificial Sequence
  Synthetic construct
aaacgggagaggttat

SEQ ID NO: 2024 - DNA, 16 bp, Artificial Sequence
  Synthetic construct
actgtccagccaggat

SEQ ID NO: 2025 - DNA, 16 bp, Artificial Sequence
  Synthetic construct
ctcgtcagtatgaaac

SEQ ID NO: 2026 - DNA, 16 bp, Artificial Sequence
  Synthetic construct
ccgtacttcttagagc

SEQ ID NO: 2027 - DNA, 16 bp, Artificial Sequence
  Synthetic construct
caagatctcaaaccgt

SEQ ID NO: 2028 - DNA, 16 bp, Artificial Sequence
  Synthetic construct
gaacctatccagtagt

SEQ ID NO: 2029 - DNA, 16 bp, Artificial Sequence
  Synthetic construct
atgtgtggtcttgtcc

SEQ ID NO: 2030 - DNA, 16 bp, Artificial Sequence
  Synthetic construct
taagtgcgtgcggtaa

SEQ ID NO: 2031 - DNA, 16 bp, Artificial Sequence
  Synthetic construct
cagaatccaagacacg

SEQ ID NO: 2032 - DNA, 16 bp, Artificial Sequence
  Synthetic construct
atgtgtgcacctatcc

SEQ ID NO: 2033 - DNA, 16 bp, Artificial Sequence
  Synthetic construct
cggagtcgtaagggaa

SEQ ID NO: 2034 - DNA, 16 bp, Artificial Sequence
  Synthetic construct
catcaagagtgaacgc

SEQ ID NO: 2035 - DNA, 16 bp, Artificial Sequence
  Synthetic construct
cgggtcatctggttcc

SEQ ID NO: 2036 - DNA, 16 bp, Artificial Sequence
  Synthetic construct
aggccgtcaaacaaca

SEQ ID NO: 2037 - DNA, 16 bp, Artificial Sequence
  Synthetic construct
acgcagccaagcctat

SEQ ID NO: 2038 - DNA, 16 bp, Artificial Sequence
  Synthetic construct
gtaggcccacggtaag

SEQ ID NO: 2039 - DNA, 16 bp, Artificial Sequence
  Synthetic construct
tcaggtacactatctt

SEQ ID NO: 2040 - DNA, 16 bp, Artificial Sequence
  Synthetic construct
tgcgggttcacttcat

SEQ ID NO: 2041 - DNA, 16 bp, Artificial Sequence
  Synthetic construct
gcatgcgagtcaaggc

SEQ ID NO: 2042 - DNA, 16 bp, Artificial Sequence
  Synthetic construct
tcacaagcaacaacct

SEQ ID NO: 2043 - DNA, 16 bp, Artificial Sequence
  Synthetic construct
gtcaagtgtaggagtc

SEQ ID NO: 2044 - DNA, 16 bp, Artificial Sequence
  Synthetic construct
actgatgtctatgtgg

SEQ ID NO: 2045 - DNA, 16 bp, Artificial Sequence
  Synthetic construct
aactttctctttagtc

SEQ ID NO: 2046 - DNA, 16 bp, Artificial Sequence
  Synthetic construct
catgacagtattaccg

SEQ ID NO: 2047 - DNA, 16 bp, Artificial Sequence
  Synthetic construct
atcatggtccgatatg

SEQ ID NO: 2048 - DNA, 16 bp, Artificial Sequence
  Synthetic construct
actgatgagataggag

SEQ ID NO: 2049 - DNA, 16 bp, Artificial Sequence
  Synthetic construct
gcatacagtacttctt

SEQ ID NO: 2050 - DNA, 16 bp, Artificial Sequence
  Synthetic construct
gggtctggtccgacgt

SEQ ID NO: 2051 - DNA, 16 bp, Artificial Sequence
  Synthetic construct
cccagttagtagcggt

SEQ ID NO: 2052 - DNA, 16 bp, Artificial Sequence
  Synthetic construct
ttgtaggcacctatcc

SEQ ID NO: 2053 - DNA, 16 bp, Artificial Sequence
  Synthetic construct
gtgttagagcaccgct

SEQ ID NO: 2054 - DNA, 16 bp, Artificial Sequence
  Synthetic construct
gcgccaatcaacgcta

SEQ ID NO: 2055 - DNA, 16 bp, Artificial Sequence
  Synthetic construct
gcgagaagtatcacca

SEQ ID NO: 2056 - DNA, 16 bp, Artificial Sequence
  Synthetic construct
gaatgaaagaagaagc

SEQ ID NO: 2057 - DNA, 16 bp, Artificial Sequence
  Synthetic construct
agctctcgttatcggt

SEQ ID NO: 2058 - DNA, 16 bp, Artificial Sequence
  Synthetic construct
gcgcaactctcgcatc

SEQ ID NO: 2059 - DNA, 16 bp, Artificial Sequence
  Synthetic construct
gcactctgtaccagtt

SEQ ID NO: 2060 - DNA, 16 bp, Artificial Sequence
  Synthetic construct
cgctatcgtgaaagag

SEQ ID NO: 2061 - DNA, 16 bp, Artificial Sequence
  Synthetic construct
cgcgttttcctaagtg

SEQ ID NO: 2062 - DNA, 16 bp, Artificial Sequence
  Synthetic construct
cgaatgtcaatccgat

SEQ ID NO: 2063 - DNA, 16 bp, Artificial Sequence
  Synthetic construct
gcaaacttctccaggg

SEQ ID NO: 2064 - DNA, 16 bp, Artificial Sequence
  Synthetic construct
cgttagagtcctgctt

SEQ ID NO: 2065 - DNA, 16 bp, Artificial Sequence
  Synthetic construct
cgatgtacattcactt

SEQ ID NO: 2066 - DNA, 16 bp, Artificial Sequence
  Synthetic construct
agagcttgttcgctaa

SEQ ID NO: 2067 - DNA, 16 bp, Artificial Sequence
  Synthetic construct
cagagagagctgaaat

SEQ ID NO: 2068 - DNA, 16 bp, Artificial Sequence
  Synthetic construct
gtcgggtcacaacgtt

SEQ ID NO: 2069 - DNA, 16 bp, Artificial Sequence
  Synthetic construct
cgaatgtgtacaagta

SEQ ID NO: 2070 - DNA, 16 bp, Artificial Sequence
  Synthetic construct
agcttgatccgcgcaa

SEQ ID NO: 2071 - DNA, 16 bp, Artificial Sequence
  Synthetic construct
cgttagatcccggatg

SEQ ID NO: 2072 - DNA, 16 bp, Artificial Sequence
  Synthetic construct
tactcgcagtagccga

SEQ ID NO: 2073 - DNA, 16 bp, Artificial Sequence
  Synthetic construct
cagcagcgttaagatg

SEQ ID NO: 2074 - DNA, 16 bp, Artificial Sequence
  Synthetic construct
catcgggaggacagaa

SEQ ID NO: 2075 - DNA, 16 bp, Artificial Sequence
  Synthetic construct
acggccaagctgcaag

SEQ ID NO: 2076 - DNA, 16 bp, Artificial Sequence
  Synthetic construct
acgaggaagaaaccta

SEQ ID NO: 2077 - DNA, 16 bp, Artificial Sequence
  Synthetic construct
cgagccacagacgcaa

SEQ ID NO: 2078 - DNA, 16 bp, Artificial Sequence
  Synthetic construct
tattaccagaagccca

SEQ ID NO: 2079 - DNA, 16 bp, Artificial Sequence
  Synthetic construct
caacctccacttacga

SEQ ID NO: 2080 - DNA, 16 bp, Artificial Sequence
  Synthetic construct
agagcgaagagatgag

SEQ ID NO: 2081 - DNA, 16 bp, Artificial Sequence
  Synthetic construct
gcacataagagactat

SEQ ID NO: 2082 - DNA, 16 bp, Artificial Sequence
  Synthetic construct
aaggagcgtagctgcc

SEQ ID NO: 2083 - DNA, 16 bp, Artificial Sequence
  Synthetic construct
gtaacgtgtgttaaga

SEQ ID NO: 2084 - DNA, 16 bp, Artificial Sequence
  Synthetic construct
atccacccacttcgaa

SEQ ID NO: 2085 - DNA, 16 bp, Artificial Sequence
  Synthetic construct
ctctacgcacctcgga

SEQ ID NO: 2086 - DNA, 16 bp, Artificial Sequence
  Synthetic construct
gaggtgaagggtatcg

SEQ ID NO: 2087 - DNA, 16 bp, Artificial Sequence
  Synthetic construct
cagctggtcaataccg

SEQ ID NO: 2088 - DNA, 16 bp, Artificial Sequence
  Synthetic construct
gggacctcaaggtgtg

SEQ ID NO: 2089 - DNA, 16 bp, Artificial Sequence
  Synthetic construct
cacactcagaaggttt

SEQ ID NO: 2090 - DNA, 16 bp, Artificial Sequence
  Synthetic construct
gatgaaagttagatga

SEQ ID NO: 2091 - DNA, 16 bp, Artificial Sequence
  Synthetic construct
ttgtaggtcctgtaga

SEQ ID NO: 2092 - DNA, 16 bp, Artificial Sequence
  Synthetic construct
actgctccagtgggat

SEQ ID NO: 2093 - DNA, 16 bp, Artificial Sequence
  Synthetic construct
ctcattaagaacaact

SEQ ID NO: 2094 - DNA, 16 bp, Artificial Sequence
  Synthetic construct
ctacattagacagacc

SEQ ID NO: 2095 - DNA, 16 bp, Artificial Sequence
  Synthetic construct
agtctttaggagcgtt

SEQ ID NO: 2096 - DNA, 16 bp, Artificial Sequence
  Synthetic construct
cttaggatccaaagtc

SEQ ID NO: 2097 - DNA, 16 bp, Artificial Sequence
  Synthetic construct
tcgtagagtcctcttg

SEQ ID NO: 2098 - DNA, 16 bp, Artificial Sequence
  Synthetic construct
attatcctccgcgttt

SEQ ID NO: 2099 - DNA, 16 bp, Artificial Sequence
  Synthetic construct
aactcttgtgagggtt

SEQ ID NO: 2100 - DNA, 16 bp, Artificial Sequence
  Synthetic construct
gtgtgcggtgacgcct

SEQ ID NO: 2101 - DNA, 16 bp, Artificial Sequence
  Synthetic construct
gggaccttcaaacaag

SEQ ID NO: 2102 - DNA, 16 bp, Artificial Sequence
  Synthetic construct
gatcagttcggaatct

SEQ ID NO: 2103 - DNA, 16 bp, Artificial Sequence
  Synthetic construct
tgcacctaggcacatg

SEQ ID NO: 2104 - DNA, 16 bp, Artificial Sequence
  Synthetic construct
aggtccgtccgcgttt

SEQ ID NO: 2105 - DNA, 16 bp, Artificial Sequence
  Synthetic construct
cctaaagtcagaggtg

SEQ ID NO: 2106 - DNA, 16 bp, Artificial Sequence
  Synthetic construct
tggttagcaatcggtt

SEQ ID NO: 2107 - DNA, 16 bp, Artificial Sequence
  Synthetic construct
atcgagtagatgtaac

SEQ ID NO: 2108 - DNA, 16 bp, Artificial Sequence
  Synthetic construct
gtgcatagtcgcgtgt

SEQ ID NO: 2109 - DNA, 16 bp, Artificial Sequence
  Synthetic construct
gcatacagtccctact

SEQ ID NO: 2110 - DNA, 16 bp, Artificial Sequence
  Synthetic construct
gcactctcagctggct

SEQ ID NO: 2111 - DNA, 16 bp, Artificial Sequence
  Synthetic construct
atgagggtcctacaga

SEQ ID NO: 2112 - DNA, 16 bp, Artificial Sequence
  Synthetic construct
ctcgaggagagcaatt

SEQ ID NO: 2113 - DNA, 16 bp, Artificial Sequence
  Synthetic construct
cacatttaggaattac

SEQ ID NO: 2114 - DNA, 16 bp, Artificial Sequence
  Synthetic construct
tgagccgagctcaact

SEQ ID NO: 2115 - DNA, 16 bp, Artificial Sequence
  Synthetic construct
catcgggagcaatctc

SEQ ID NO: 2116 - DNA, 16 bp, Artificial Sequence
  Synthetic construct
tcagctccacatttct

SEQ ID NO: 2117 - DNA, 16 bp, Artificial Sequence
  Synthetic construct
gcgcagtagcgtttac

SEQ ID NO: 2118 - DNA, 16 bp, Artificial Sequence
  Synthetic construct
catattctcagagctt

SEQ ID NO: 2119 - DNA, 16 bp, Artificial Sequence
  Synthetic construct
ccacctatcatctgcc

SEQ ID NO: 2120 - DNA, 16 bp, Artificial Sequence
  Synthetic construct
cgaccttcagcgttcg

SEQ ID NO: 2121 - DNA, 16 bp, Artificial Sequence
  Synthetic construct
gttaagccactctgtc

SEQ ID NO: 2122 - DNA, 16 bp, Artificial Sequence
  Synthetic construct
ttgtagggtgaaggct

SEQ ID NO: 2123 - DNA, 16 bp, Artificial Sequence
  Synthetic construct
cacataggtcgcgtgt

SEQ ID NO: 2124 - DNA, 16 bp, Artificial Sequence
  Synthetic construct
gacagagcaagaagag

SEQ ID NO: 2125 - DNA, 16 bp, Artificial Sequence
  Synthetic construct
gacagagcatacagct

SEQ ID NO: 2126 - DNA, 16 bp, Artificial Sequence
  Synthetic construct
gcttccagtcccgaca

SEQ ID NO: 2127 - DNA, 16 bp, Artificial Sequence
  Synthetic construct
agatctgcaagcgagt

SEQ ID NO: 2128 - DNA, 16 bp, Artificial Sequence
  Synthetic construct
tgagccgcactaagtc

SEQ ID NO: 2129 - DNA, 16 bp, Artificial Sequence
  Synthetic construct
tctgagatctactatc

SEQ ID NO: 2130 - DNA, 16 bp, Artificial Sequence
  Synthetic construct
accagtacatccaaca

SEQ ID NO: 2131 - DNA, 16 bp, Artificial Sequence
  Synthetic construct
tcggtaaagatgcctt

SEQ ID NO: 2132 - DNA, 16 bp, Artificial Sequence
  Synthetic construct
taaaccgaggatgcgt

SEQ ID NO: 2133 - DNA, 16 bp, Artificial Sequence
  Synthetic construct
ctagtgaaggttccta

SEQ ID NO: 2134 - DNA, 16 bp, Artificial Sequence
  Synthetic construct
accgtaacattgagct

SEQ ID NO: 2135 - DNA, 16 bp, Artificial Sequence
  Synthetic construct
ccatgtcgtcacctaa

SEQ ID NO: 2136 - DNA, 16 bp, Artificial Sequence
  Synthetic construct
tgcgggttcctagaac

SEQ ID NO: 2137 - DNA, 16 bp, Artificial Sequence
  Synthetic construct
actttcaaggcaggtt

SEQ ID NO: 2138 - DNA, 16 bp, Artificial Sequence
  Synthetic construct
gcactctcacgaggta

SEQ ID NO: 2139 - DNA, 16 bp, Artificial Sequence
  Synthetic construct
tgttccgagaactcgg

SEQ ID NO: 2140 - DNA, 16 bp, Artificial Sequence
  Synthetic construct
gaaactcagggtgtgt

SEQ ID NO: 2141 - DNA, 16 bp, Artificial Sequence
  Synthetic construct
tcggtaatcctgcagg

SEQ ID NO: 2142 - DNA, 16 bp, Artificial Sequence
  Synthetic construct
cgatgtatcctttaca

SEQ ID NO: 2143 - DNA, 16 bp, Artificial Sequence
  Synthetic construct
tacttacaggtgctag

SEQ ID NO: 2144 - DNA, 16 bp, Artificial Sequence
  Synthetic construct
tttatgcgtacttctt

SEQ ID NO: 2145 - DNA, 16 bp, Artificial Sequence
  Synthetic construct
atcgagtcaggacgta

SEQ ID NO: 2146 - DNA, 16 bp, Artificial Sequence
  Synthetic construct
gactaacgttaaagac

SEQ ID NO: 2147 - DNA, 16 bp, Artificial Sequence
  Synthetic construct
gatgaaatccacgtgg

SEQ ID NO: 2148 - DNA, 16 bp, Artificial Sequence
  Synthetic construct
cgaccttaggctaggt

SEQ ID NO: 2149 - DNA, 16 bp, Artificial Sequence
  Synthetic construct
tgcgtggcatagaaac

SEQ ID NO: 2150 - DNA, 16 bp, Artificial Sequence
  Synthetic construct
ggacagatccctaatt

SEQ ID NO: 2151 - DNA, 16 bp, Artificial Sequence
  Synthetic construct
agagtgggtctggtcg

SEQ ID NO: 2152 - DNA, 16 bp, Artificial Sequence
  Synthetic construct
ctcattacatccgcga

SEQ ID NO: 2153 - DNA, 16 bp, Artificial Sequence
  Synthetic construct
tctattgcactgccag

SEQ ID NO: 2154 - DNA, 16 bp, Artificial Sequence
  Synthetic construct
aaggttccagttcatg

SEQ ID NO: 2155 - DNA, 16 bp, Artificial Sequence
  Synthetic construct
tgctacccaagtagta

SEQ ID NO: 2156 - DNA, 16 bp, Artificial Sequence
  Synthetic construct
ttgtaggcacggtaga

SEQ ID NO: 2157 - DNA, 16 bp, Artificial Sequence
  Synthetic construct
agtgtcaagttaggta

SEQ ID NO: 2158 - DNA, 16 bp, Artificial Sequence
  Synthetic construct
ggacattcaatccgat

SEQ ID NO: 2159 - DNA, 16 bp, Artificial Sequence
  Synthetic construct
ccagcgagtaagagga

SEQ ID NO: 2160 - DNA, 16 bp, Artificial Sequence
  Synthetic construct
gggtctggtggacgat

SEQ ID NO: 2161 - DNA, 16 bp, Artificial Sequence
  Synthetic construct
ttagttcgtaggctga

SEQ ID NO: 2162 - DNA, 16 bp, Artificial Sequence
  Synthetic construct
ctcggaggtcttgtcc

SEQ ID NO: 2163 - DNA, 16 bp, Artificial Sequence
  Synthetic construct
actatctcagggttag

SEQ ID NO: 2164 - DNA, 16 bp, Artificial Sequence
  Synthetic construct
aaggagctcttgagac

SEQ ID NO: 2165 - DNA, 16 bp, Artificial Sequence
  Synthetic construct
ctcacactcctgcagg

SEQ ID NO: 2166 - DNA, 16 bp, Artificial Sequence
  Synthetic construct
atccaccaggatgtat

SEQ ID NO: 2167 - DNA, 16 bp, Artificial Sequence
  Synthetic construct
gttctcgtcggcgcat

SEQ ID NO: 2168 - DNA, 16 bp, Artificial Sequence
  Synthetic construct
gctctgttctccaggg

SEQ ID NO: 2169 - DNA, 16 bp, Artificial Sequence
  Synthetic construct
tacttactcggttcgg

SEQ ID NO: 2170 - DNA, 16 bp, Artificial Sequence
  Synthetic construct
atttctgaggcccgtt

SEQ ID NO: 2171 - DNA, 16 bp, Artificial Sequence
  Synthetic construct
gctgggtcacatgact

SEQ ID NO: 2172 - DNA, 16 bp, Artificial Sequence
  Synthetic construct
acgtcaatccaagccg

SEQ ID NO: 2173 - DNA, 16 bp, Artificial Sequence
  Synthetic construct
gactacacaaagcaat

SEQ ID NO: 2174 - DNA, 16 bp, Artificial Sequence
  Synthetic construct
gtcctcaagggagtaa

SEQ ID NO: 2175 - DNA, 16 bp, Artificial Sequence
  Synthetic construct
cctagcttctccggtt

SEQ ID NO: 2176 - DNA, 16 bp, Artificial Sequence
  Synthetic construct
atcatggcatcctaga

SEQ ID NO: 2177 - DNA, 16 bp, Artificial Sequence
  Synthetic construct
aggtcatagggtcgat

SEQ ID NO: 2178 - DNA, 16 bp, Artificial Sequence
  Synthetic construct
agtgtcacagacgtag

SEQ ID NO: 2179 - DNA, 16 bp, Artificial Sequence
  Synthetic construct
gtcaagtagacaaagg

SEQ ID NO: 2180 - DNA, 16 bp, Artificial Sequence
  Synthetic construct
agcggtctcctgccat

SEQ ID NO: 2181 - DNA, 16 bp, Artificial Sequence
  Synthetic construct
acatacgagtctcctc

SEQ ID NO: 2182 - DNA, 16 bp, Artificial Sequence
  Synthetic construct
gggttgctcgtctgaa

SEQ ID NO: 2183 - DNA, 16 bp, Artificial Sequence
  Synthetic construct
gttacagcaagttgtc

SEQ ID NO: 2184 - DNA, 16 bp, Artificial Sequence
  Synthetic construct
gattcagagcagatcg

SEQ ID NO: 2185 - DNA, 16 bp, Artificial Sequence
  Synthetic construct
ccgtggaagctggaac

SEQ ID NO: 2186 - DNA, 16 bp, Artificial Sequence
  Synthetic construct
aaagtagcacaagccc

SEQ ID NO: 2187 - DNA, 16 bp, Artificial Sequence
  Synthetic construct
cagaatcagtagtgcg

SEQ ID NO: 2188 - DNA, 16 bp, Artificial Sequence
  Synthetic construct
acccactcagctgtgc

SEQ ID NO: 2189 - DNA, 16 bp, Artificial Sequence
  Synthetic construct
caagatctcggaggta

SEQ ID NO: 2190 - DNA, 16 bp, Artificial Sequence
  Synthetic construct
caggtgctcggccgat

SEQ ID NO: 2191 - DNA, 16 bp, Artificial Sequence
  Synthetic construct
cggttaaagtttcctt

SEQ ID NO: 2192 - DNA, 16 bp, Artificial Sequence
  Synthetic construct
ctacattgtagaagga

SEQ ID NO: 2193 - DNA, 16 bp, Artificial Sequence
  Synthetic construct
ctcacacgtggtgtag

SEQ ID NO: 2194 - DNA, 16 bp, Artificial Sequence
  Synthetic construct
gctcctaagcctcgtg

SEQ ID NO: 2195 - DNA, 16 bp, Artificial Sequence
  Synthetic construct
ggctggtgtcgattgt

SEQ ID NO: 2196 - DNA, 16 bp, Artificial Sequence
  Synthetic construct
ggtgaaggttccggca

SEQ ID NO: 2197 - DNA, 16 bp, Artificial Sequence
  Synthetic construct
gtgcagctcaactctt

SEQ ID NO: 2198 - DNA, 16 bp, Artificial Sequence
  Synthetic construct
gtgttagcacttctgc

SEQ ID NO: 2199 - DNA, 16 bp, Artificial Sequence
  Synthetic construct
tacagtgtcgcgtttc

SEQ ID NO: 2200 - DNA, 16 bp, Artificial Sequence
  Synthetic construct
tggttagtcattatcc

SEQ ID NO: 2201 - DNA, 16 bp, Artificial Sequence
  Synthetic construct
ttcttagaggagttta

SEQ ID NO: 2202 - DNA, 16 bp, Artificial Sequence
  Synthetic construct
gtgaaggcagtggagt

SEQ ID NO: 2203 - DNA, 16 bp, Artificial Sequence
  Synthetic construct
cacacaacaattgctg

SEQ ID NO: 2204 - DNA, 16 bp, Artificial Sequence
  Synthetic construct
gcaatcagttccggca

SEQ ID NO: 2205 - DNA, 16 bp, Artificial Sequence
  Synthetic construct
caccttgtctgaaaga

SEQ ID NO: 2206 - DNA, 16 bp, Artificial Sequence
  Synthetic construct
ccagcgatcgtagatc

SEQ ID NO: 2207 - DNA, 16 bp, Artificial Sequence
  Synthetic construct
gaataagtcttctggc

SEQ ID NO: 2208 - DNA, 16 bp, Artificial Sequence
  Synthetic construct
ctctggtgtcaatgtc

SEQ ID NO: 2209 - DNA, 16 bp, Artificial Sequence
  Synthetic construct
accagtatcagttgac

SEQ ID NO: 2210 - DNA, 16 bp, Artificial Sequence
  Synthetic construct
tgtcccacacgctttc

SEQ ID NO: 2211 - DNA, 16 bp, Artificial Sequence
  Synthetic construct
cttaggagtgcaacga

SEQ ID NO: 2212 - DNA, 16 bp, Artificial Sequence
  Synthetic construct
gaggtgacaatggtct

SEQ ID NO: 2213 - DNA, 16 bp, Artificial Sequence
  Synthetic construct
gcaaacttcagcctaa

SEQ ID NO: 2214 - DNA, 16 bp, Artificial Sequence
  Synthetic construct
cttaccgtcagtcagt

SEQ ID NO: 2215 - DNA, 16 bp, Artificial Sequence
  Synthetic construct
gcgaccacactgaagg

SEQ ID NO: 2216 - DNA, 16 bp, Artificial Sequence
  Synthetic construct
cttaactcagatgggt

SEQ ID NO: 2217 - DNA, 16 bp, Artificial Sequence
  Synthetic construct
catcgaatcatcaccc

SEQ ID NO: 2218 - DNA, 16 bp, Artificial Sequence
  Synthetic construct
ccatgtcgtgcgatag

SEQ ID NO: 2219 - DNA, 16 bp, Artificial Sequence
  Synthetic construct
cctacactcagtccct

SEQ ID NO: 2220 - DNA, 16 bp, Artificial Sequence
  Synthetic construct
tctattgtcttatctg

SEQ ID NO: 2221 - DNA, 16 bp, Artificial Sequence
  Synthetic construct
ttaggcaagaactgta

SEQ ID NO: 2222 - DNA, 16 bp, Artificial Sequence
  Synthetic construct
tgcgcaggtgcggtaa

SEQ ID NO: 2223 - DNA, 16 bp, Artificial Sequence
  Synthetic construct
gtgaaggtcgttacga

SEQ ID NO: 2224 - DNA, 16 bp, Artificial Sequence
  Synthetic construct
gggcatccagcatgag

SEQ ID NO: 2225 - DNA, 16 bp, Artificial Sequence
  Synthetic construct
gaacctatccaaatgc

SEQ ID NO: 2226 - DNA, 16 bp, Artificial Sequence
  Synthetic construct
gcaaactgtctcttta

SEQ ID NO: 2227 - DNA, 16 bp, Artificial Sequence
  Synthetic construct
ggctcgatcaggcgaa

SEQ ID NO: 2228 - DNA, 16 bp, Artificial Sequence
  Synthetic construct
gttctcgtccggcaca

SEQ ID NO: 2229 - DNA, 16 bp, Artificial Sequence
  Synthetic construct
attggacagctaccgc

SEQ ID NO: 2230 - DNA, 16 bp, Artificial Sequence
  Synthetic construct
gatcagtgttgattgc

SEQ ID NO: 2231 - DNA, 16 bp, Artificial Sequence
  Synthetic construct
ctacattgttccacaa

SEQ ID NO: 2232 - DNA, 16 bp, Artificial Sequence
  Synthetic construct
aacacgtcaatggaat

SEQ ID NO: 2233 - DNA, 16 bp, Artificial Sequence
  Synthetic construct
ccttacgtccagtatg

SEQ ID NO: 2234 - DNA, 16 bp, Artificial Sequence
  Synthetic construct
aactggtagacctagg

SEQ ID NO: 2235 - DNA, 16 bp, Artificial Sequence
  Synthetic construct
gaagcagcacgtcagc

SEQ ID NO: 2236 - DNA, 16 bp, Artificial Sequence
  Synthetic construct
aacgttgcagtgacag

SEQ ID NO: 2237 - DNA, 16 bp, Artificial Sequence
  Synthetic construct
cgagaaggtatctgca

SEQ ID NO: 2238 - DNA, 16 bp, Artificial Sequence
  Synthetic construct
ctgataggtggcccta

SEQ ID NO: 2239 - DNA, 16 bp, Artificial Sequence
  Synthetic construct
gggaatgtcgccagca

SEQ ID NO: 2240 - DNA, 16 bp, Artificial Sequence
  Synthetic construct
aaccgcggtatagtag

SEQ ID NO: 2241 - DNA, 16 bp, Artificial Sequence
  Synthetic construct
tcgcgttcagggattg

SEQ ID NO: 2242 - DNA, 16 bp, Artificial Sequence
  Synthetic construct
tcaggattcatcattc

SEQ ID NO: 2243 - DNA, 16 bp, Artificial Sequence
  Synthetic construct
agcgtatcatctatgg

SEQ ID NO: 2244 - DNA, 16 bp, Artificial Sequence
  Synthetic construct
gtgttaggtatgaaac

SEQ ID NO: 2245 - DNA, 16 bp, Artificial Sequence
  Synthetic construct
acgccagcaagttgtc

SEQ ID NO: 2246 - DNA, 16 bp, Artificial Sequence
  Synthetic construct
ccacctatcttgggta

SEQ ID NO: 2247 - DNA, 16 bp, Artificial Sequence
  Synthetic construct
tactcgcgttctcatt

SEQ ID NO: 2248 - DNA, 16 bp, Artificial Sequence
  Synthetic construct
ctgctgtgtagtacct

SEQ ID NO: 2249 - DNA, 16 bp, Artificial Sequence
  Synthetic construct
agggagtagaaggaca

SEQ ID NO: 2250 - DNA, 16 bp, Artificial Sequence
  Synthetic construct
cggacactctcacatt

SEQ ID NO: 2251 - DNA, 16 bp, Artificial Sequence
  Synthetic construct
tgtggtatcgtatcag

SEQ ID NO: 2252 - DNA, 16 bp, Artificial Sequence
  Synthetic construct
acatcagtctatcccg

SEQ ID NO: 2253 - DNA, 16 bp, Artificial Sequence
  Synthetic construct
cattcgcagtgaacgc

SEQ ID NO: 2254 - DNA, 16 bp, Artificial Sequence
  Synthetic construct
attggtgtcacaacgt

SEQ ID NO: 2255 - DNA, 16 bp, Artificial Sequence
  Synthetic construct
tgacggcgtcctcttg

SEQ ID NO: 2256 - DNA, 16 bp, Artificial Sequence
  Synthetic construct
ctgtttaagtttagga

SEQ ID NO: 2257 - DNA, 16 bp, Artificial Sequence
  Synthetic construct
gggagattcagctctc

SEQ ID NO: 2258 - DNA, 16 bp, Artificial Sequence
  Synthetic construct
gagtccgtctgctgct

SEQ ID NO: 2259 - DNA, 16 bp, Artificial Sequence
  Synthetic construct
tcacaagcatccaaca

SEQ ID NO: 2260 - DNA, 16 bp, Artificial Sequence
  Synthetic construct
catgcctgtacttagc

SEQ ID NO: 2261 - DNA, 16 bp, Artificial Sequence
  Synthetic construct
acatcaggttgagttc

SEQ ID NO: 2262 - DNA, 16 bp, Artificial Sequence
  Synthetic construct
ctacacccacacagag

SEQ ID NO: 2263 - DNA, 16 bp, Artificial Sequence
  Synthetic construct
agggtgaagcaatatg

SEQ ID NO: 2264 - DNA, 16 bp, Artificial Sequence
  Synthetic construct
agacgtttcagcgacc

SEQ ID NO: 2265 - DNA, 16 bp, Artificial Sequence
  Synthetic construct
ccagcgaagcgattct

SEQ ID NO: 2266 - DNA, 16 bp, Artificial Sequence
  Synthetic construct
gcagttagtgcaggta

SEQ ID NO: 2267 - DNA, 16 bp, Artificial Sequence
  Synthetic construct
ctcctaggtcgattgt

SEQ ID NO: 2268 - DNA, 16 bp, Artificial Sequence
  Synthetic construct
aaggttcgtctctctg

SEQ ID NO: 2269 - DNA, 16 bp, Artificial Sequence
  Synthetic construct
cctaccatcgtgacat

SEQ ID NO: 2270 - DNA, 16 bp, Artificial Sequence
  Synthetic construct
gcttgaaagcatcatc

SEQ ID NO: 2271 - DNA, 16 bp, Artificial Sequence
  Synthetic construct
tcttcggcacacatgt

SEQ ID NO: 2272 - DNA, 16 bp, Artificial Sequence
  Synthetic construct
aactggtagtatgaca

SEQ ID NO: 2273 - DNA, 16 bp, Artificial Sequence
  Synthetic construct
ggtgttatcagaggtg

SEQ ID NO: 2274 - DNA, 16 bp, Artificial Sequence
  Synthetic construct
tactcgctcttaccgc

SEQ ID NO: 2275 - DNA, 16 bp, Artificial Sequence
  Synthetic construct
cggagctaggcgacat

SEQ ID NO: 2276 - DNA, 16 bp, Artificial Sequence
  Synthetic construct
acgagcccagatgagc

SEQ ID NO: 2277 - DNA, 16 bp, Artificial Sequence
  Synthetic construct
actgagtgtgaggcta

SEQ ID NO: 2278 - DNA, 16 bp, Artificial Sequence
  Synthetic construct
gagtccgagaaacgcc

SEQ ID NO: 2279 - DNA, 16 bp, Artificial Sequence
  Synthetic construct
gcatgtaagctaggca

SEQ ID NO: 2280 - DNA, 16 bp, Artificial Sequence
  Synthetic construct
acgccgacacccatgg

SEQ ID NO: 2281 - DNA, 16 bp, Artificial Sequence
  Synthetic construct
atcacgatcacatgca

SEQ ID NO: 2282 - DNA, 16 bp, Artificial Sequence
  Synthetic construct
attatcctctgcagta

SEQ ID NO: 2283 - DNA, 16 bp, Artificial Sequence
  Synthetic construct
ccacggacatgtcctc

SEQ ID NO: 2284 - DNA, 16 bp, Artificial Sequence
  Synthetic construct
acggagatcatgtagc

SEQ ID NO: 2285 - DNA, 16 bp, Artificial Sequence
  Synthetic construct
tagaccatccgatatg

SEQ ID NO: 2286 - DNA, 16 bp, Artificial Sequence
  Synthetic construct
tgagaggtcgcgtttc

SEQ ID NO: 2287 - DNA, 16 bp, Artificial Sequence
  Synthetic construct
ttgccgtcaatcacac

SEQ ID NO: 2288 - DNA, 16 bp, Artificial Sequence
  Synthetic construct
catccactctccaacc

SEQ ID NO: 2289 - DNA, 16 bp, Artificial Sequence
  Synthetic construct
catatggagtgggttg

SEQ ID NO: 2290 - DNA, 16 bp, Artificial Sequence
  Synthetic construct
tctggaaagccacctg

SEQ ID NO: 2291 - DNA, 16 bp, Artificial Sequence
  Synthetic construct
gggcactagagtgacc

SEQ ID NO: 2292 - DNA, 16 bp, Artificial Sequence
  Synthetic construct
tcgaggcgtctgcaat

SEQ ID NO: 2293 - DNA, 16 bp, Artificial Sequence
  Synthetic construct
caagatcagctaactc

SEQ ID NO: 2294 - DNA, 16 bp, Artificial Sequence
  Synthetic construct
cgtagcgtccgtcatc

SEQ ID NO: 2295 - DNA, 16 bp, Artificial Sequence
  Synthetic construct
caggtgcagataggag

SEQ ID NO: 2296 - DNA, 16 bp, Artificial Sequence
  Synthetic construct
cgtgtctagtagccga

SEQ ID NO: 2297 - DNA, 16 bp, Artificial Sequence
  Synthetic construct
cctaaagtctagcaca

SEQ ID NO: 2298 - DNA, 16 bp, Artificial Sequence
  Synthetic construct
caagttgcacacagag

SEQ ID NO: 2299 - DNA, 16 bp, Artificial Sequence
  Synthetic construct
ctacatttccacgtgg

SEQ ID NO: 2300 - DNA, 16 bp, Artificial Sequence
  Synthetic construct
tttggttcaaagcaat

SEQ ID NO: 2301 - DNA, 16 bp, Artificial Sequence
  Synthetic construct
ttgaacgtcccaggtg

SEQ ID NO: 2302 - DNA, 16 bp, Artificial Sequence
  Synthetic construct
gtgcttcgtacagtgg

SEQ ID NO: 2303 - DNA, 16 bp, Artificial Sequence
  Synthetic construct
tcaggtatcatgtagc

SEQ ID NO: 2304 - DNA, 16 bp, Artificial Sequence
  Synthetic construct
ttatgctagcagactg

SEQ ID NO: 2305 - DNA, 16 bp, Artificial Sequence
  Synthetic construct
acgtcaacacatttct

SEQ ID NO: 2306 - DNA, 16 bp, Artificial Sequence
  Synthetic construct
tcttcggcaagacgtg

SEQ ID NO: 2307 - DNA, 16 bp, Artificial Sequence
  Synthetic construct
agcctaacaagccgtc

SEQ ID NO: 2308 - DNA, 16 bp, Artificial Sequence
  Synthetic construct
agggatggttccactc

SEQ ID NO: 2309 - DNA, 16 bp, Artificial Sequence
  Synthetic construct
aggtccggtagctccg

SEQ ID NO: 2310 - DNA, 16 bp, Artificial Sequence
  Synthetic construct
gggatgaagtgaagag

SEQ ID NO: 2311 - DNA, 16 bp, Artificial Sequence
  Synthetic construct
ccatgtccaagttaag

SEQ ID NO: 2312 - DNA, 16 bp, Artificial Sequence
  Synthetic construct
agatctgtcagcgatt

SEQ ID NO: 2313 - DNA, 16 bp, Artificial Sequence
  Synthetic construct
agcagccagaaaccat

SEQ ID NO: 2314 - DNA, 16 bp, Artificial Sequence
  Synthetic construct
tactcgcagtgtccat

SEQ ID NO: 2315 - DNA, 16 bp, Artificial Sequence
  Synthetic construct
aaatgccagccctaat

SEQ ID NO: 2316 - DNA, 16 bp, Artificial Sequence
  Synthetic construct
ttaggcacatccgcga

SEQ ID NO: 2317 - DNA, 16 bp, Artificial Sequence
  Synthetic construct
tcagctccacaccgca

SEQ ID NO: 2318 - DNA, 16 bp, Artificial Sequence
  Synthetic construct
catcagacacggctac

SEQ ID NO: 2319 - DNA, 16 bp, Artificial Sequence
  Synthetic construct
tgctgctgtagctccg

SEQ ID NO: 2320 - DNA, 16 bp, Artificial Sequence
  Synthetic construct
gtcttcgaggaccaca

SEQ ID NO: 2321 - DNA, 16 bp, Artificial Sequence
  Synthetic construct
ctcgggaagctgaaat

SEQ ID NO: 2322 - DNA, 16 bp, Artificial Sequence
  Synthetic construct
cacactcgttcacggc

SEQ ID NO: 2323 - DNA, 16 bp, Artificial Sequence
  Synthetic construct
tggttcctcccattta

SEQ ID NO: 2324 - DNA, 16 bp, Artificial Sequence
  Synthetic construct
ggacagacaatggtct

SEQ ID NO: 2325 - DNA, 16 bp, Artificial Sequence
  Synthetic construct
ccatgtccaatggagc

SEQ ID NO: 2326 - DNA, 16 bp, Artificial Sequence
  Synthetic construct
tgactagtcggaaacg

SEQ ID NO: 2327 - DNA, 16 bp, Artificial Sequence
  Synthetic construct
ctgcggatcggagcaa

SEQ ID NO: 2328 - DNA, 16 bp, Artificial Sequence
  Synthetic construct
tcgcgagtcttgaggt

SEQ ID NO: 2329 - DNA, 16 bp, Artificial Sequence
  Synthetic construct
acctttaagtctcggc

SEQ ID NO: 2330 - DNA, 16 bp, Artificial Sequence
  Synthetic construct
tcagctctcaccctca

SEQ ID NO: 2331 - DNA, 16 bp, Artificial Sequence
  Synthetic construct
ctctacgcacagcgtc

SEQ ID NO: 2332 - DNA, 16 bp, Artificial Sequence
  Synthetic construct
cagctgggttcgggct

SEQ ID NO: 2333 - DNA, 16 bp, Artificial Sequence
  Synthetic construct
aagccgcagagttggc

SEQ ID NO: 2334 - DNA, 16 bp, Artificial Sequence
  Synthetic construct
acaccggtctcattca

SEQ ID NO: 2335 - DNA, 16 bp, Artificial Sequence
  Synthetic construct
cacaccttcgatccct

SEQ ID NO: 2336 - DNA, 16 bp, Artificial Sequence
  Synthetic construct
cgtgtaagtttcgctc

SEQ ID NO: 2337 - DNA, 16 bp, Artificial Sequence
  Synthetic construct
cgagcacgtccatgat

SEQ ID NO: 2338 - DNA, 16 bp, Artificial Sequence
  Synthetic construct
cccatactcttcggtc

SEQ ID NO: 2339 - DNA, 16 bp, Artificial Sequence
  Synthetic construct
gcacatatccgtcatc

SEQ ID NO: 2340 - DNA, 16 bp, Artificial Sequence
  Synthetic construct
ggaaagctcgaatggg

SEQ ID NO: 2341 - DNA, 16 bp, Artificial Sequence
  Synthetic construct
ggaataagtcggatcc

SEQ ID NO: 2342 - DNA, 16 bp, Artificial Sequence
  Synthetic construct
tttatgccaaaggcgt

SEQ ID NO: 2343 - DNA, 16 bp, Artificial Sequence
  Synthetic construct
acatcagcatcagtac

SEQ ID NO: 2344 - DNA, 16 bp, Artificial Sequence
  Synthetic construct
ttcccagtccctaacc

SEQ ID NO: 2345 - DNA, 16 bp, Artificial Sequence
  Synthetic construct
gcagccaagtgggttg

SEQ ID NO: 2346 - DNA, 16 bp, Artificial Sequence
  Synthetic construct
tgtggtatctgcaagt

SEQ ID NO: 2347 - DNA, 16 bp, Artificial Sequence
  Synthetic construct
tgtcccacagggagag

SEQ ID NO: 2348 - DNA, 16 bp, Artificial Sequence
  Synthetic construct
ataagaggtgcaactt

SEQ ID NO: 2349 - DNA, 16 bp, Artificial Sequence
  Synthetic construct
agggagttcagaaatg

SEQ ID NO: 2350 - DNA, 16 bp, Artificial Sequence
  Synthetic construct
ctcgaaaagtagtgcg

SEQ ID NO: 2351 - DNA, 16 bp, Artificial Sequence
  Synthetic construct
acgatgttcttagccc

SEQ ID NO: 2352 - DNA, 16 bp, Artificial Sequence
  Synthetic construct
gtgcttccacatcttt

SEQ ID NO: 2353 - DNA, 16 bp, Artificial Sequence
  Synthetic construct
ttaggacgtcctagcg

SEQ ID NO: 2354 - DNA, 16 bp, Artificial Sequence
  Synthetic construct
ataagagcaagaagag

SEQ ID NO: 2355 - DNA, 16 bp, Artificial Sequence
  Synthetic construct
gctgcgatcgaggtag

SEQ ID NO: 2356 - DNA, 16 bp, Artificial Sequence
  Synthetic construct
gtacgtacagatgagc

SEQ ID NO: 2357 - DNA, 16 bp, Artificial Sequence
  Synthetic construct
cacacctgtcatatcg

SEQ ID NO: 2358 - DNA, 16 bp, Artificial Sequence
  Synthetic construct
acgcagctccggcaca

SEQ ID NO: 2359 - DNA, 16 bp, Artificial Sequence
  Synthetic construct
acttacttccctaacc

SEQ ID NO: 2360 - DNA, 16 bp, Artificial Sequence
  Synthetic construct
agacgtttcctgcagg

SEQ ID NO: 2361 - DNA, 16 bp, Artificial Sequence
  Synthetic construct
gaagcagagtgcaagc

SEQ ID NO: 2362 - DNA, 16 bp, Artificial Sequence
  Synthetic construct
cctaaagtcgcgtttc

SEQ ID NO: 2363 - DNA, 16 bp, Artificial Sequence
  Synthetic construct
ccttcgaagagcaatt

SEQ ID NO: 2364 - DNA, 16 bp, Artificial Sequence
  Synthetic construct
taagagatcagtgcat

SEQ ID NO: 2365 - DNA, 16 bp, Artificial Sequence
  Synthetic construct
taccttagtgaggcta

SEQ ID NO: 2366 - DNA, 16 bp, Artificial Sequence
  Synthetic construct
tcgcgttgtatagggc

SEQ ID NO: 2367 - DNA, 16 bp, Artificial Sequence
  Synthetic construct
agggatgagaatgttg

SEQ ID NO: 2368 - DNA, 16 bp, Artificial Sequence
  Synthetic construct
atccgaagtgttcgat

SEQ ID NO: 2369 - DNA, 16 bp, Artificial Sequence
  Synthetic construct
agcatacaggagttta

SEQ ID NO: 2370 - DNA, 16 bp, Artificial Sequence
  Synthetic construct
agaatagtctccctga

SEQ ID NO: 2371 - DNA, 16 bp, Artificial Sequence
  Synthetic construct
ccacctatcagaggtg

SEQ ID NO: 2372 - DNA, 16 bp, Artificial Sequence
  Synthetic construct
gactgcgagcctatgt

SEQ ID NO: 2373 - DNA, 16 bp, Artificial Sequence
  Synthetic construct
atccaccagtgaagtt

SEQ ID NO: 2374 - DNA, 16 bp, Artificial Sequence
  Synthetic construct
catatggtccctcttt

SEQ ID NO: 2375 - DNA, 16 bp, Artificial Sequence
  Synthetic construct
gagtccgtcgatgagg

SEQ ID NO: 2376 - DNA, 16 bp, Artificial Sequence
  Synthetic construct
ggaataagtttcgctc

SEQ ID NO: 2377 - DNA, 16 bp, Artificial Sequence
  Synthetic construct
acttgttgtagggact

SEQ ID NO: 2378 - DNA, 16 bp, Artificial Sequence
  Synthetic construct
agcggtcgtgtgtgcc

SEQ ID NO: 2379 - DNA, 16 bp, Artificial Sequence
  Synthetic construct
tctgagagtgggtatg

SEQ ID NO: 2380 - DNA, 16 bp, Artificial Sequence
  Synthetic construct
aactggtagctcctct

SEQ ID NO: 2381 - DNA, 16 bp, Artificial Sequence
  Synthetic construct
acttactgttgtacac

SEQ ID NO: 2382 - DNA, 16 bp, Artificial Sequence
  Synthetic construct
gcctctatcggccgat

SEQ ID NO: 2383 - DNA, 16 bp, Artificial Sequence
  Synthetic construct
ttgccgtcagcgtcca

SEQ ID NO: 2384 - DNA, 16 bp, Artificial Sequence
  Synthetic construct
ggacagagttagggtg

SEQ ID NO: 2385 - DNA, 16 bp, Artificial Sequence
  Synthetic construct
tgacggcagttatcgc

SEQ ID NO: 2386 - DNA, 16 bp, Artificial Sequence
  Synthetic construct
tcattaccatcggaag

SEQ ID NO: 2387 - DNA, 16 bp, Artificial Sequence
  Synthetic construct
atttctgtctgcccta

SEQ ID NO: 2388 - DNA, 16 bp, Artificial Sequence
  Synthetic construct
acccactagtccgtat

SEQ ID NO: 2389 - DNA, 16 bp, Artificial Sequence
  Synthetic construct
cggacgtgtggtaacg

SEQ ID NO: 2390 - DNA, 16 bp, Artificial Sequence
  Synthetic construct
atttctggttgaggtg

SEQ ID NO: 2391 - DNA, 16 bp, Artificial Sequence
  Synthetic construct
actgagttctatcgcc

SEQ ID NO: 2392 - DNA, 16 bp, Artificial Sequence
  Synthetic construct
cacattttcttaccgc

SEQ ID NO: 2393 - DNA, 16 bp, Artificial Sequence
  Synthetic construct
ttgccgttcacgcata

SEQ ID NO: 2394 - DNA, 16 bp, Artificial Sequence
  Synthetic construct
acactgaagacttgaa

SEQ ID NO: 2395 - DNA, 16 bp, Artificial Sequence
  Synthetic construct
gagtccgagatctgct

SEQ ID NO: 2396 - DNA, 16 bp, Artificial Sequence
  Synthetic construct
gtgaaggtctgcccta

SEQ ID NO: 2397 - DNA, 16 bp, Artificial Sequence
  Synthetic construct
gaaactccattgggcc

SEQ ID NO: 2398 - DNA, 16 bp, Artificial Sequence
  Synthetic construct
atcatctagtggagaa

SEQ ID NO: 2399 - DNA, 16 bp, Artificial Sequence
  Synthetic construct
tgagcatgtgcatcta

SEQ ID NO: 2400 - DNA, 16 bp, Artificial Sequence
  Synthetic construct
ggatgtttctccaacc

SEQ ID NO: 2401 - DNA, 16 bp, Artificial Sequence
  Synthetic construct
aactcagcaagctgga

SEQ ID NO: 2402 - DNA, 16 bp, Artificial Sequence
  Synthetic construct
cacacctcatgctggc

SEQ ID NO: 2403 - DNA, 16 bp, Artificial Sequence
  Synthetic construct
attggaccaatagagt

SEQ ID NO: 2404 - DNA, 16 bp, Artificial Sequence
  Synthetic construct
aacacgtaggcccttg

SEQ ID NO: 2405 - DNA, 16 bp, Artificial Sequence
  Synthetic construct
cgttggggttcgcgac

SEQ ID NO: 2406 - DNA, 16 bp, Artificial Sequence
  Synthetic construct
gacgcgtagggatacc

SEQ ID NO: 2407 - DNA, 16 bp, Artificial Sequence
  Synthetic construct
agcctaaaggcgctct

SEQ ID NO: 2408 - DNA, 16 bp, Artificial Sequence
  Synthetic construct
gtgtgcgtcctatgtt

SEQ ID NO: 2409 - DNA, 16 bp, Artificial Sequence
  Synthetic construct
acgggctcaggtctcg

SEQ ID NO: 2410 - DNA, 16 bp, Artificial Sequence
  Synthetic construct
gtcttcgagtcaatag

SEQ ID NO: 2411 - DNA, 16 bp, Artificial Sequence
  Synthetic construct
gcatgatagcgcttat

SEQ ID NO: 2412 - DNA, 16 bp, Artificial Sequence
  Synthetic construct
gcctctagttgagttc

SEQ ID NO: 2413 - DNA, 16 bp, Artificial Sequence
  Synthetic construct
ctagtgatccttcaat

SEQ ID NO: 2414 - DNA, 16 bp, Artificial Sequence
  Synthetic construct
tgagcatgtgtcctct

SEQ ID NO: 2415 - DNA, 16 bp, Artificial Sequence
  Synthetic construct
gcaatcacacttaagc

SEQ ID NO: 2416 - DNA, 16 bp, Artificial Sequence
  Synthetic construct
ggccgatcatgttccc

SEQ ID NO: 2417 - DNA, 16 bp, Artificial Sequence
  Synthetic construct
ctcggagcagcagttt

SEQ ID NO: 2418 - DNA, 16 bp, Artificial Sequence
  Synthetic construct
aaatgcccacaacgtt

SEQ ID NO: 2419 - DNA, 16 bp, Artificial Sequence
  Synthetic construct
gcatgattccacgacg

SEQ ID NO: 2420 - DNA, 16 bp, Artificial Sequence
  Synthetic construct
ttgtaggagtcacgcc

SEQ ID NO: 2421 - DNA, 16 bp, Artificial Sequence
  Synthetic construct
acagctaaggtgatta

SEQ ID NO: 2422 - DNA, 16 bp, Artificial Sequence
  Synthetic construct
ctgaagtcactgccag

SEQ ID NO: 2423 - DNA, 16 bp, Artificial Sequence
  Synthetic construct
acgatgttctactcat

SEQ ID NO: 2424 - DNA, 16 bp, Artificial Sequence
  Synthetic construct
tttcctcgtacagttc

SEQ ID NO: 2425 - DNA, 16 bp, Artificial Sequence
  Synthetic construct
attggtgaggacatta

SEQ ID NO: 2426 - DNA, 16 bp, Artificial Sequence
  Synthetic construct
cctttctcagctggct

SEQ ID NO: 2427 - DNA, 16 bp, Artificial Sequence
  Synthetic construct
acatggtcacatgact

SEQ ID NO: 2428 - DNA, 16 bp, Artificial Sequence
  Synthetic construct
gccaaatagcgtcaag

SEQ ID NO: 2429 - DNA, 16 bp, Artificial Sequence
  Synthetic construct
cgtcagggtaacgcga

SEQ ID NO: 2430 - DNA, 16 bp, Artificial Sequence
  Synthetic construct
ctagccttccgaacgc

SEQ ID NO: 2431 - DNA, 16 bp, Artificial Sequence
  Synthetic construct
gtttctatcgccaaat

SEQ ID NO: 2432 - DNA, 16 bp, Artificial Sequence
  Synthetic construct
tacggtagtccagtta

SEQ ID NO: 2433 - DNA, 16 bp, Artificial Sequence
  Synthetic construct
tgtattcgtctagtca

SEQ ID NO: 2434 - DNA, 16 bp, Artificial Sequence
  Synthetic construct
cgttggggtaatcacc

SEQ ID NO: 2435 - DNA, 16 bp, Artificial Sequence
  Synthetic construct
agttggtcacgttggc

SEQ ID NO: 2436 - DNA, 16 bp, Artificial Sequence
  Synthetic construct
ccgtactcacgttggc

SEQ ID NO: 2437 - DNA, 16 bp, Artificial Sequence
  Synthetic construct
gatgagggttatcacg

SEQ ID NO: 2438 - DNA, 16 bp, Artificial Sequence
  Synthetic construct
aagtctgcatggatgg

SEQ ID NO: 2439 - DNA, 16 bp, Artificial Sequence
  Synthetic construct
ctcgagggtctcttat

SEQ ID NO: 2440 - DNA, 16 bp, Artificial Sequence
  Synthetic construct
tgtattcagcgaaggg

SEQ ID NO: 2441 - DNA, 16 bp, Artificial Sequence
  Synthetic construct
tcttcggagcacacag

SEQ ID NO: 2442 - DNA, 16 bp, Artificial Sequence
  Synthetic construct
tcatttgtcgtttatc

SEQ ID NO: 2443 - DNA, 16 bp, Artificial Sequence
  Synthetic construct
cattcgcgtatagggc

SEQ ID NO: 2444 - DNA, 16 bp, Artificial Sequence
  Synthetic construct
catattcagactacaa

SEQ ID NO: 2445 - DNA, 16 bp, Artificial Sequence
  Synthetic construct
tttgtcatcactctta

SEQ ID NO: 2446 - DNA, 16 bp, Artificial Sequence
  Synthetic construct
gcgagaaagtgccaga

SEQ ID NO: 2447 - DNA, 16 bp, Artificial Sequence
  Synthetic construct
gcgcgattctccaggg

SEQ ID NO: 2448 - DNA, 16 bp, Artificial Sequence
  Synthetic construct
cggctagcagagccaa

SEQ ID NO: 2449 - DNA, 16 bp, Artificial Sequence
  Synthetic construct
cagagagaggctcatt

SEQ ID NO: 2450 - DNA, 16 bp, Artificial Sequence
  Synthetic construct
gttaagccacaccgca

SEQ ID NO: 2451 - DNA, 16 bp, Artificial Sequence
  Synthetic construct
atgggagagccggtaa

SEQ ID NO: 2452 - DNA, 16 bp, Artificial Sequence
  Synthetic construct
tacggtaaggcacatg

SEQ ID NO: 2453 - DNA, 16 bp, Artificial Sequence
  Synthetic construct
cctattagttcagtac

SEQ ID NO: 2454 - DNA, 16 bp, Artificial Sequence
  Synthetic construct
tgctacctcctgcagg

SEQ ID NO: 2455 - DNA, 16 bp, Artificial Sequence
  Synthetic construct
tacctatgttccacaa

SEQ ID NO: 2456 - DNA, 16 bp, Artificial Sequence
  Synthetic construct
taagagagtccaacta

SEQ ID NO: 2457 - DNA, 16 bp, Artificial Sequence
  Synthetic construct
ggcaattgtccgaacc

SEQ ID NO: 2458 - DNA, 16 bp, Artificial Sequence
  Synthetic construct
ctcattatcattgcga

SEQ ID NO: 2459 - DNA, 16 bp, Artificial Sequence
  Synthetic construct
tcattacgtggaaaga

SEQ ID NO: 2460 - DNA, 16 bp, Artificial Sequence
  Synthetic construct
gcgagaagtccatcct

SEQ ID NO: 2461 - DNA, 16 bp, Artificial Sequence
  Synthetic construct
attctactcctttcgg

SEQ ID NO: 2462 - DNA, 16 bp, Artificial Sequence
  Synthetic construct
gatcagttcaacggcc

SEQ ID NO: 2463 - DNA, 16 bp, Artificial Sequence
  Synthetic construct
agcttgatccgtagta

SEQ ID NO: 2464 - DNA, 16 bp, Artificial Sequence
  Synthetic construct
aactcttagctgataa

SEQ ID NO: 2465 - DNA, 16 bp, Artificial Sequence
  Synthetic construct
acactgacatgatcca

SEQ ID NO: 2466 - DNA, 16 bp, Artificial Sequence
  Synthetic construct
ataagagtctgatacg

SEQ ID NO: 2467 - DNA, 16 bp, Artificial Sequence
  Synthetic construct
agcttgatccaaacac

SEQ ID NO: 2468 - DNA, 16 bp, Artificial Sequence
  Synthetic construct
taagagatccgtaggc

SEQ ID NO: 2469 - DNA, 16 bp, Artificial Sequence
  Synthetic construct
gatcgcgtccttgacc

SEQ ID NO: 2470 - DNA, 16 bp, Artificial Sequence
  Synthetic construct
gtcatttcagtaagat

SEQ ID NO: 2471 - DNA, 16 bp, Artificial Sequence
  Synthetic construct
gtaacgtagaaggaca

SEQ ID NO: 2472 - DNA, 16 bp, Artificial Sequence
  Synthetic construct
atccgaagttaagatg

SEQ ID NO: 2473 - DNA, 16 bp, Artificial Sequence
  Synthetic construct
attctacaggtagcca

SEQ ID NO: 2474 - DNA, 16 bp, Artificial Sequence
  Synthetic construct
gaacggagtgactact

SEQ ID NO: 2475 - DNA, 16 bp, Artificial Sequence
  Synthetic construct
tacttgtagtacgacg

SEQ ID NO: 2476 - DNA, 16 bp, Artificial Sequence
  Synthetic construct
tctctaacagttaacc

SEQ ID NO: 2477 - DNA, 16 bp, Artificial Sequence
  Synthetic construct
actgctccacagaggt

SEQ ID NO: 2478 - DNA, 16 bp, Artificial Sequence
  Synthetic construct
aatccaggtccatgat

SEQ ID NO: 2479 - DNA, 16 bp, Artificial Sequence
  Synthetic construct
gatcgataggcgacat

SEQ ID NO: 2480 - DNA, 16 bp, Artificial Sequence
  Synthetic construct
tcggtaatcaacgaaa

SEQ ID NO: 2481 - DNA, 16 bp, Artificial Sequence
  Synthetic construct
tggccagcaccgctag

SEQ ID NO: 2482 - DNA, 16 bp, Artificial Sequence
  Synthetic construct
agcggtctcacctcgt

SEQ ID NO: 2483 - DNA, 16 bp, Artificial Sequence
  Synthetic construct
cgtgtaatcgtgggaa

SEQ ID NO: 2484 - DNA, 16 bp, Artificial Sequence
  Synthetic construct
tcattacgtaccgtta

SEQ ID NO: 2485 - DNA, 16 bp, Artificial Sequence
  Synthetic construct
cctttctaggattcgg

SEQ ID NO: 2486 - DNA, 16 bp, Artificial Sequence
  Synthetic construct
cacacaagtagattag

SEQ ID NO: 2487 - DNA, 16 bp, Artificial Sequence
  Synthetic construct
atgcgattctgtccgt

SEQ ID NO: 2488 - DNA, 16 bp, Artificial Sequence
  Synthetic construct
tcccgatagactagat

SEQ ID NO: 2489 - DNA, 16 bp, Artificial Sequence
  Synthetic construct
gcgggtttcttctggc

SEQ ID NO: 2490 - DNA, 16 bp, Artificial Sequence
  Synthetic construct
gcactcttcacttcat

SEQ ID NO: 2491 - DNA, 16 bp, Artificial Sequence
  Synthetic construct
gtcgggtcaccacgtg

SEQ ID NO: 2492 - DNA, 16 bp, Artificial Sequence
  Synthetic construct
attctaccacagaggt

SEQ ID NO: 2493 - DNA, 16 bp, Artificial Sequence
  Synthetic construct
tgcccatcaatgttgc

SEQ ID NO: 2494 - DNA, 16 bp, Artificial Sequence
  Synthetic construct
ttctcaacaggtttca

SEQ ID NO: 2495 - DNA, 16 bp, Artificial Sequence
  Synthetic construct
gtcctcatcaacacca

SEQ ID NO: 2496 - DNA, 16 bp, Artificial Sequence
  Synthetic construct
gggacctgtaagttcc

SEQ ID NO: 2497 - DNA, 16 bp, Artificial Sequence
  Synthetic construct
catgcctgtttgtttc

SEQ ID NO: 2498 - DNA, 16 bp, Artificial Sequence
  Synthetic construct
gggtctgagggctctc

SEQ ID NO: 2499 - DNA, 16 bp, Artificial Sequence
  Synthetic construct
gttacagaggagtacc

SEQ ID NO: 2500 - DNA, 16 bp, Artificial Sequence
  Synthetic construct
cagctggtccaatggt

SEQ ID NO: 2501 - DNA, 16 bp, Artificial Sequence
  Synthetic construct
gtgtgcgaggcccgtt

SEQ ID NO: 2502 - DNA, 16 bp, Artificial Sequence
  Synthetic construct
gaacctatcctcaacc

SEQ ID NO: 2503 - DNA, 16 bp, Artificial Sequence
  Synthetic construct
ctcacaccagggcata

SEQ ID NO: 2504 - DNA, 16 bp, Artificial Sequence
  Synthetic construct
gctgcttcaatgttgc

SEQ ID NO: 2505 - DNA, 16 bp, Artificial Sequence
  Synthetic construct
tgctgctgtaaagtca

SEQ ID NO: 2506 - DNA, 16 bp, Artificial Sequence
  Synthetic construct
cacacctagcaatctc

SEQ ID NO: 2507 - DNA, 16 bp, Artificial Sequence
  Synthetic construct
tcgaggccagcttaac

SEQ ID NO: 2508 - DNA, 16 bp, Artificial Sequence
  Synthetic construct
cagatcaagtagccga

SEQ ID NO: 2509 - DNA, 16 bp, Artificial Sequence
  Synthetic construct
actttcaaggcattgg

SEQ ID NO: 2510 - DNA, 16 bp, Artificial Sequence
  Synthetic construct
cacaggcagttaacga

SEQ ID NO: 2511 - DNA, 16 bp, Artificial Sequence
  Synthetic construct
cctctgacagtcagag

SEQ ID NO: 2512 - DNA, 16 bp, Artificial Sequence
  Synthetic construct
tcatttggttccatga

SEQ ID NO: 2513 - DNA, 16 bp, Artificial Sequence
  Synthetic construct
ccaatcccacaccgac

SEQ ID NO: 2514 - DNA, 16 bp, Artificial Sequence
  Synthetic construct
gttctcgcatagactc

SEQ ID NO: 2515 - DNA, 16 bp, Artificial Sequence
  Synthetic construct
ctctacgtccctcttt

SEQ ID NO: 2516 - DNA, 16 bp, Artificial Sequence
  Synthetic construct
ccgtactaggagttta

SEQ ID NO: 2517 - DNA, 16 bp, Artificial Sequence
  Synthetic construct
catccacgtctcacct

SEQ ID NO: 2518 - DNA, 16 bp, Artificial Sequence
  Synthetic construct
tcattacagtggagaa

SEQ ID NO: 2519 - DNA, 16 bp, Artificial Sequence
  Synthetic construct
cgtcagggtcacccag

SEQ ID NO: 2520 - DNA, 16 bp, Artificial Sequence
  Synthetic construct
acctttacagttcatg

SEQ ID NO: 2521 - DNA, 16 bp, Artificial Sequence
  Synthetic construct
ggcgtgtcaatagagt

SEQ ID NO: 2522 - DNA, 16 bp, Artificial Sequence
  Synthetic construct
tttactgtcagagacg

SEQ ID NO: 2523 - DNA, 16 bp, Artificial Sequence
  Synthetic construct
tagccggtccacgttc

SEQ ID NO: 2524 - DNA, 16 bp, Artificial Sequence
  Synthetic construct
tttactgtcctttaca

SEQ ID NO: 2525 - DNA, 16 bp, Artificial Sequence
  Synthetic construct
gtcgggtcaggctcac

SEQ ID NO: 2526 - DNA, 16 bp, Artificial Sequence
  Synthetic construct
actgaactctgtttgt

SEQ ID NO: 2527 - DNA, 16 bp, Artificial Sequence
  Synthetic construct
ctgctgtagtcctcct

SEQ ID NO: 2528 - DNA, 16 bp, Artificial Sequence
  Synthetic construct
catattcgtttgactg

SEQ ID NO: 2529 - DNA, 16 bp, Artificial Sequence
  Synthetic construct
ccttcgatcacaggcc

SEQ ID NO: 2530 - DNA, 16 bp, Artificial Sequence
  Synthetic construct
ctgaaacagatcccat

SEQ ID NO: 2531 - DNA, 16 bp, Artificial Sequence
  Synthetic construct
tcaggattcataaagg

SEQ ID NO: 2532 - DNA, 16 bp, Artificial Sequence
  Synthetic construct
ttgccgtgttcgaatc

SEQ ID NO: 2533 - DNA, 16 bp, Artificial Sequence
  Synthetic construct
gatcgtagtcaagcga

SEQ ID NO: 2534 - DNA, 16 bp, Artificial Sequence
  Synthetic construct
ttatgcttcatgtagc

SEQ ID NO: 2535 - DNA, 16 bp, Artificial Sequence
  Synthetic construct
tgttccgtctccaacc

SEQ ID NO: 2536 - DNA, 16 bp, Artificial Sequence
  Synthetic construct
tcgtacccacagacag

SEQ ID NO: 2537 - DNA, 16 bp, Artificial Sequence
  Synthetic construct
cattcgcgtctcaaca

SEQ ID NO: 2538 - DNA, 16 bp, Artificial Sequence
  Synthetic construct
attatcctcttgagac

SEQ ID NO: 2539 - DNA, 16 bp, Artificial Sequence
  Synthetic construct
gtaggcccacggtaga

SEQ ID NO: 2540 - DNA, 16 bp, Artificial Sequence
  Synthetic construct
cgttgggtcatctgcc

SEQ ID NO: 2541 - DNA, 16 bp, Artificial Sequence
  Synthetic construct
cgcgttttctgtgcaa

SEQ ID NO: 2542 - DNA, 16 bp, Artificial Sequence
  Synthetic construct
gaggtgacagtttacg

SEQ ID NO: 2543 - DNA, 16 bp, Artificial Sequence
  Synthetic construct
ctgatcccatctccca

SEQ ID NO: 2544 - DNA, 16 bp, Artificial Sequence
  Synthetic construct
tactcgcgtcttgtcc

SEQ ID NO: 2545 - DNA, 16 bp, Artificial Sequence
  Synthetic construct
ctgcggagtgtgcctg

SEQ ID NO: 2546 - DNA, 16 bp, Artificial Sequence
  Synthetic construct
tagtggtgtattagcc

SEQ ID NO: 2547 - DNA, 16 bp, Artificial Sequence
  Synthetic construct
tcagatgaggagtaga

SEQ ID NO: 2548 - DNA, 16 bp, Artificial Sequence
  Synthetic construct
tttcctcgtgtttggt

SEQ ID NO: 2549 - DNA, 16 bp, Artificial Sequence
  Synthetic construct
cacactcgtaagtagt

SEQ ID NO: 2550 - DNA, 16 bp, Artificial Sequence
  Synthetic construct
ccaatccagttagcgg

SEQ ID NO: 2551 - DNA, 16 bp, Artificial Sequence
  Synthetic construct
atcacgacaagccgtc

SEQ ID NO: 2552 - DNA, 16 bp, Artificial Sequence
  Synthetic construct
agaatagtcttgacga

SEQ ID NO: 2553 - DNA, 16 bp, Artificial Sequence
  Synthetic construct
ggaacttagttgagta

SEQ ID NO: 2554 - DNA, 16 bp, Artificial Sequence
  Synthetic construct
atcgagtagtttgcgt

SEQ ID NO: 2555 - DNA, 16 bp, Artificial Sequence
  Synthetic construct
aaggcagcaaggtgtg

SEQ ID NO: 2556 - DNA, 16 bp, Artificial Sequence
  Synthetic construct
ccctccttcatcgatg

SEQ ID NO: 2557 - DNA, 16 bp, Artificial Sequence
  Synthetic construct
atccacctcaaacaag

SEQ ID NO: 2558 - DNA, 16 bp, Artificial Sequence
  Synthetic construct
ctgcggacatatgctg

SEQ ID NO: 2559 - DNA, 16 bp, Artificial Sequence
  Synthetic construct
gcgggttcatgcaatc

SEQ ID NO: 2560 - DNA, 16 bp, Artificial Sequence
  Synthetic construct
tctgagatcaggtaaa

SEQ ID NO: 2561 - DNA, 16 bp, Artificial Sequence
  Synthetic construct
agtgagggtcgtggct

SEQ ID NO: 2562 - DNA, 16 bp, Artificial Sequence
  Synthetic construct
atgagggcactacagt

SEQ ID NO: 2563 - DNA, 16 bp, Artificial Sequence
  Synthetic construct
gaacctagtcaaagat

SEQ ID NO: 2564 - DNA, 16 bp, Artificial Sequence
  Synthetic construct
tctgagacaatggacg

SEQ ID NO: 2565 - DNA, 16 bp, Artificial Sequence
  Synthetic construct
cgttctgaggacagct

SEQ ID NO: 2566 - DNA, 16 bp, Artificial Sequence
  Synthetic construct
catgacatcatttggg

SEQ ID NO: 2567 - DNA, 16 bp, Artificial Sequence
  Synthetic construct
cgccaagagctttggt

SEQ ID NO: 2568 - DNA, 16 bp, Artificial Sequence
  Synthetic construct
gattcagagaggttgc

SEQ ID NO: 2569 - DNA, 16 bp, Artificial Sequence
  Synthetic construct
ttaactcagtaatccc

SEQ ID NO: 2570 - DNA, 16 bp, Artificial Sequence
  Synthetic construct
cagctaatcgctagcg

SEQ ID NO: 2571 - DNA, 16 bp, Artificial Sequence
  Synthetic construct
cgcttcatcatctgcc

SEQ ID NO: 2572 - DNA, 16 bp, Artificial Sequence
  Synthetic construct
tattaccgtcgcgtgt

SEQ ID NO: 2573 - DNA, 16 bp, Artificial Sequence
  Synthetic construct
catcgaagtccgacgt

SEQ ID NO: 2574 - DNA, 16 bp, Artificial Sequence
  Synthetic construct
tttgtcagtcagaagc

SEQ ID NO: 2575 - DNA, 16 bp, Artificial Sequence
  Synthetic construct
cccatactcagcctaa

SEQ ID NO: 2576 - DNA, 16 bp, Artificial Sequence
  Synthetic construct
cgtccattcgaactgt

SEQ ID NO: 2577 - DNA, 16 bp, Artificial Sequence
  Synthetic construct
ctcattatcgtaggag

SEQ ID NO: 2578 - DNA, 16 bp, Artificial Sequence
  Synthetic construct
taagcgtgtcggcact

SEQ ID NO: 2579 - DNA, 16 bp, Artificial Sequence
  Synthetic construct
catcgggtcaaccatg

SEQ ID NO: 2580 - DNA, 16 bp, Artificial Sequence
  Synthetic construct
acagccgtcttgggta

SEQ ID NO: 2581 - DNA, 16 bp, Artificial Sequence
  Synthetic construct
tggctgggttactgac

SEQ ID NO: 2582 - DNA, 16 bp, Artificial Sequence
  Synthetic construct
gcgaccatcagcaact

SEQ ID NO: 2583 - DNA, 16 bp, Artificial Sequence
  Synthetic construct
cgagcacagtgtttgc

SEQ ID NO: 2584 - DNA, 16 bp, Artificial Sequence
  Synthetic construct
atctactgtaacgacg

SEQ ID NO: 2585 - DNA, 16 bp, Artificial Sequence
  Synthetic construct
agcttgacatcacgat

SEQ ID NO: 2586 - DNA, 16 bp, Artificial Sequence
  Synthetic construct
acgtcaagtgactcat

SEQ ID NO: 2587 - DNA, 16 bp, Artificial Sequence
  Synthetic construct
catggcgcatcggtta

SEQ ID NO: 2588 - DNA, 16 bp, Artificial Sequence
  Synthetic construct
accgtaagtagcaaat

SEQ ID NO: 2589 - DNA, 16 bp, Artificial Sequence
  Synthetic construct
ctagagtcatgcaatc

SEQ ID NO: 2590 - DNA, 16 bp, Artificial Sequence
  Synthetic construct
caggtgccaatcacac

SEQ ID NO: 2591 - DNA, 16 bp, Artificial Sequence
  Synthetic construct
ctgtttacaagtctgt

SEQ ID NO: 2592 - DNA, 16 bp, Artificial Sequence
  Synthetic construct
gaacctatcatggtca

SEQ ID NO: 2593 - DNA, 16 bp, Artificial Sequence
  Synthetic construct
gttcgggtccctaatt

SEQ ID NO: 2594 - DNA, 16 bp, Artificial Sequence
  Synthetic construct
gtagtcatcaaagaca

SEQ ID NO: 2595 - DNA, 16 bp, Artificial Sequence
  Synthetic construct
ttaggcacagtaagat

SEQ ID NO: 2596 - DNA, 16 bp, Artificial Sequence
  Synthetic construct
gcaatcagtgacaaat

SEQ ID NO: 2597 - DNA, 16 bp, Artificial Sequence
  Synthetic construct
acagctatcccaagat

SEQ ID NO: 2598 - DNA, 16 bp, Artificial Sequence
  Synthetic construct
gcgggttcattaaccg

SEQ ID NO: 2599 - DNA, 16 bp, Artificial Sequence
  Synthetic construct
cagagagagagtaatc

SEQ ID NO: 2600 - DNA, 16 bp, Artificial Sequence
  Synthetic construct
ctcgggacatagactc

SEQ ID NO: 2601 - DNA, 16 bp, Artificial Sequence
  Synthetic construct
cccagttgtggcccta

SEQ ID NO: 2602 - DNA, 16 bp, Artificial Sequence
  Synthetic construct
actgatgaggaatgga

SEQ ID NO: 2603 - DNA, 16 bp, Artificial Sequence
  Synthetic construct
actgagtagcacacag

SEQ ID NO: 2604 - DNA, 16 bp, Artificial Sequence
  Synthetic construct
aactcttagttgagta

SEQ ID NO: 2605 - DNA, 16 bp, Artificial Sequence
  Synthetic construct
cgctggaagaattgtg

SEQ ID NO: 2606 - DNA, 16 bp, Artificial Sequence
  Synthetic construct
tacttaccacgaagca

SEQ ID NO: 2607 - DNA, 16 bp, Artificial Sequence
  Synthetic construct
agaatagtcttgccgt

SEQ ID NO: 2608 - DNA, 16 bp, Artificial Sequence
  Synthetic construct
gaaatgatcattgccc

SEQ ID NO: 2609 - DNA, 16 bp, Artificial Sequence
  Synthetic construct
aaacctgtcctgtacc

SEQ ID NO: 2610 - DNA, 16 bp, Artificial Sequence
  Synthetic construct
catattcgtcaaagcg

SEQ ID NO: 2611 - DNA, 16 bp, Artificial Sequence
  Synthetic construct
ctaatggcatatggtc

SEQ ID NO: 2612 - DNA, 16 bp, Artificial Sequence
  Synthetic construct
aactcagcagcatact

SEQ ID NO: 2613 - DNA, 16 bp, Artificial Sequence
  Synthetic construct
tagttgggtcgcatat

SEQ ID NO: 2614 - DNA, 16 bp, Artificial Sequence
  Synthetic construct
cttaccgtcgatccct

SEQ ID NO: 2615 - DNA, 16 bp, Artificial Sequence
  Synthetic construct
gagcagagtgcactta

SEQ ID NO: 2616 - DNA, 16 bp, Artificial Sequence
  Synthetic construct
cgtaggccagacgcaa

SEQ ID NO: 2617 - DNA, 16 bp, Artificial Sequence
  Synthetic construct
acaccctaggcgtaca

SEQ ID NO: 2618 - DNA, 16 bp, Artificial Sequence
  Synthetic construct
acatcagtcggcgcta

SEQ ID NO: 2619 - DNA, 16 bp, Artificial Sequence
  Synthetic construct
gcttgaaagacataac

SEQ ID NO: 2620 - DNA, 16 bp, Artificial Sequence
  Synthetic construct
cagctaatcgacggaa

SEQ ID NO: 2621 - DNA, 16 bp, Artificial Sequence
  Synthetic construct
tttgcgcagcacacag

SEQ ID NO: 2622 - DNA, 16 bp, Artificial Sequence
  Synthetic construct
tctgagacatggtcat

SEQ ID NO: 2623 - DNA, 16 bp, Artificial Sequence
  Synthetic construct
aactttctccgtcaaa

SEQ ID NO: 2624 - DNA, 16 bp, Artificial Sequence
  Synthetic construct
tctctaaagcgccttg

SEQ ID NO: 2625 - DNA, 16 bp, Artificial Sequence
  Synthetic construct
taagtgctcagtgcat

SEQ ID NO: 2626 - DNA, 16 bp, Artificial Sequence
  Synthetic construct
cctagctgttcaggcc

SEQ ID NO: 2627 - DNA, 16 bp, Artificial Sequence
  Synthetic construct
accagtagtgtcaatc

SEQ ID NO: 2628 - DNA, 199 bp, Artificial Sequence
  Synthetic construct
ggggccctcaagagtcgaatcatcatctccctagacacgtccaagaatcagttctccctgaaactgagctctgtgaccgccgcagacacggctgtgtattactgtgcgagacatcgggattacgacattttgactggttattatatgggggactactttgactactggggccagggaaccctggtcaccgtctcctcag

SEQ ID NO: 2629 - DNA, 147 bp, Artificial Sequence
  Synthetic construct
gggggaaccagttctccctgacgctgagctctgtgaccgccgcagacacggctatatattactgtgcgagacttaacttggggttcctacagattgggggttcccttgatatctggggccaagggacactggtcaccgtctcttcag

SEQ ID NO: 2630 - DNA, 170 bp, Artificial Sequence
  Synthetic construct
atttggggcagtggacacgtccaagaaccagttctccctgaggctggactctgtgaccgctgcagacacggccgtgtattactgtgcgagagctcggggttattattatgatagtagtggttatcaaattgactactggggccagggaaccctggtcaccgtctcctcag

SEQ ID NO: 2631 - DNA, 231 bp, Artificial Sequence
  Synthetic construct
ggggaaatcaatcatagtggaagcaccaactacaacccgtccctcaagagtcgagtcaccatatcaatagacacgtccaagaagcaggtctccctgaagttgagctctgtgaacgccgcggacacggctgtgtattactgtgcgagagttattactagggcgagtcctggcacagacgggaggtacggtatggacgtctggggccaagggaccacggtcaccgtctcctca

SEQ ID NO: 2632 - DNA, 279 bp, Artificial Sequence
  Synthetic construct
ggacaagggcttgaatggattggaggcagcatccctatgtatgaaacaacaaattacgcacagaagttccagggcagggtcaacatcgtcgcggacgtatacacgagcacagcctacatggaggtgaacagcctgacgcctgaggacacggctgtatatttctgcgcgcggggccacagtagctcgtctcaacggtctagcttcgacggtaactttttatactactactatcaccaaatggacgtctggggcacagggaccacggtcaccgtctccaca

SEQ ID NO: 2633 - DNA, 277 bp, Artificial Sequence
  Synthetic construct
gggatccggcagcccgccgggaagggactggagtggattgggcgaattcaaagcggtgggaccacccattacaacccctccctcaggagtcgtgtcagcatctcactagactcgtcacagaaccaattttctctgcaattgagatctgtgacccccgcagacacggccgtgtatttctgtgtgacttctttaattcggccatattgtagtggcggtgtctgctattcgaactggttcgacccctggggcccgggaacccaggtcaccgtctcctcag

SEQ ID NO: 2634 - DNA, 370 bp, Artificial Sequence
  Synthetic construct
caggtgcagctggtacagtctggagctgaggtgaagaagcctggggcctcagtgaaggtctcttgtaaggcttccgattacagttttaccacctatggaaccatctgggtgcgacaggcccctggacaagggcttgagtggatgggatggatcagcggtcataatggtaacacaaattatgcacagaagttccagggcagagtctccatgaccacagacacatccacgaccacagcctacatggagctgaggagtctgagatctgacgactcggccgtgtactactgtgcgagaggtcggggattgcagcaccagctgacagactggttcgacccctggggccagggaaccctggtcaccgtctcctcag

SEQ ID NO: 2635 - DNA, 317 bp, Artificial Sequence
  Synthetic construct
tgtatgggcatgcaaggcctctggatacaccttcaccggtttctacataaactgggtgcgacaggcccctggacaagggcttgagtggatggccataatcaaccctactggtgctaccacaggtatcgcacagaagttccagggcagagtcaccatgaccagggacaggtccacgagcacagttttcctggagttgcgcagtctgagatctgacgacacggccgtctattattgtgcgagagtcccccccccgggagtggctaataataagtggttcgacctctggggccagggaacccgggtcaccgtctcctcag

SEQ ID NO: 2636 - DNA, 382 bp, Artificial Sequence
  Synthetic construct
caggtccagctggtgcagtctggggctgaggtgaagaagcctgggtcctcggtgaaggtctcctgcgagacctctggaggcaccttcggcagctctgctataagctggctgcgacaggcccctggacaaggactcgaatggatgggaggaatcatccctctgtttgattcaccaatgtacgcagagaaatttcagggcagagtcgcgattaccacggacgaatccacgaacacagcctacctggagctgggcggcctgaaatcagaggacacggccgtgtatttttgtgcgagaggggaaggtccggggacttatatagtctcggggcgatggggctactttgagttctggggccagggaaccctggtcaccgtctcctcag

SEQ ID NO: 2637 - DNA, 361 bp, Artificial Sequence
  Synthetic construct
gaggtgcagctggtggagtctgggggaggcttggtccagcctggggggtccctgaaactctcctgtgcagcctctgggttcatgttcagtggttctactatacactgggtccgccaggcccccgggaaagggctggagtgggttggccgtattcgaaccaagactttcaattacgcgacagcatatggtacgtcgatgaagggcaggttcaccttctccagagatgattcaaggagcacggcatatcttcaaataaacagcctgaaacccgaggacacggccgtgtattattgtggtagaccaggaatggcagaagttggtacttattggggccagggaaccctggtcaccgtctcctcag

SEQ ID NO: 2638 - DNA, 373 bp, Artificial Sequence
  Synthetic construct
caggtgcacctggtggagtctgggggaggcgtggtccagcctgggaggtccctgagactctcctgtgcggcctctggattcaccttcagtagctatggcatacactgggtccgccaggctccaggcaaggggccggagtgggtggcagttatatcatatgatggaaatgataaatattatgcagactccgtgaagggccgattcaccatctccagggacaactccaagaacacggtgtatctgcaaatgaacagcctgagagctgaggacacggctatgtattactgtgcgaaagatcgcagtagtggctggtaccggggttttggggggattgactactggggccagggaaccctggtcaccgtctcctcag

SEQ ID NO: 2639 - DNA, 355 bp, Artificial Sequence
  Synthetic construct
caggtgcacctggtggagtccgggggaggcgtggtccagcctgggaggtccctgagactctcgtgtgtaggctctggattcaccttcgatagttatggcatacactgggtccgccaggctccaggcaaggggctggagtgggtgtcacttatatcgtatgatggaagcaatatatactatgcagactccgtgaagggccgtttcaccatctccagagacaattccaagaacacggtgtatttacaaatgaacagcctgcgacctgaggacacggctgtttactactgttcgagaaggagggctgggcccgattttgattactggggccggggaaccctggtcaccgtctcctcag

SEQ ID NO: 2640 - DNA, 367 bp, Artificial Sequence
  Synthetic construct
gaggtgcagttggtggagtctgggggaggcttggtccagccgggggggtccctaagactctcctgtgcagcctcaggcttcaccttcagtggctctgctatacactgggtccgccaggcttccgggaaagggctggagtggcttgcccgtattagaagcagttctaacaaatatgcgacatcttatgctgcgtcggtgacaggcaggttcatcatctccagagatgatcccaagaacacggcgtttctgcagatggacagtctgaaaaccgaggacacggccatatattattgtactacccgacatcaatattgtactactaccaggtgcccctggggccagggaaccctggtcaccgtctcctcag

SEQ ID NO: 2641 - DNA, 358 bp, Artificial Sequence
  Synthetic construct
gagatgcagctggtggagtccgggggaggcttggtccagccgggggggtccctgagactctcctgtgcagcctctgggttctccttcagtggctcggctatacactgggtccgccaggcttccgggaaagggctggagtgggtcggccgcaccagaagtaaggcaaacaatttcgcgacagactatgcctcgtcggtgagaggcaggttcaccatctccagagatgattcaaagaacacggcgtacttgcaaatgaacagcctgaagaccgaggacacggccgtctattattgtacggccgcgcgagttgcctggttcgacccctggggccagggaaccaaggtcaccgtctcctcag

SEQ ID NO: 2642 - DNA, 367 bp, Artificial Sequence
  Synthetic construct
gaggtgcggctggtggagtctggggggggcttggtccagcctggggggtccctgaaactctcctgtgaagcgtctgggttcaccttcagtgagtctgcaatacactgggtccgccaggcttccgggaaggggctgcagtgggttggccatattaaaagcaaaagtaacaactatgcgacagtatacggtgcgtcggtgaaaggcaggttcaccatctccagagatgattcgaacaacacggcgtttctgcaaatgagcagcctgaaacccgaggacacggccctgtattattgcacgacaatattcggagaagtgttatatccttttgactcctggggccagggaaccctggtcaccgtctcctcag

SEQ ID NO: 2643 - DNA, 370 bp, Artificial Sequence
  Synthetic construct
gaggtccagttggtacagtccggggctgaggtgaagaagcctggggccaccgtgaaaatctcctgcaaggcttctggatacaccttcaccgactactacatacactgggtgaagcaggcccctggaaaagggcttgagtggatgggacgtgttggtcctaaacctggtgaaacagtatatacagagaagttccagggcagagtcaccatgaccgcgaacacgtcttcagacacagccttcatggagctgagcagcctaagatctgacgacacggccttttattactgtgcaacagtgtataccaatgcctggtacggaggcgcgggttttgactactggggccagggaagcctggtcaccgtctcctcag

SEQ ID NO: 2644 - DNA, 385 bp, Artificial Sequence
  Synthetic construct
caggtgcagttggtgcagtctggggctgaggtgaagaagcctggggcctcagtgaagatttcctgcaagtcatctggatacaccttcaccagttactatatacactgggtgcgacaggcccctggacaagggcttgactggatgggaattttcaaccctagtgccgataccaaaacctacgcacacaagttccagggcagagtcaccatgaccagggacacgtccacgagcacagtctacatggaactgagcagattgagatctgaggacacggccgtgtattactgtgcgagagcggcaattaaacgggatgggtatggttcggggagttatccagatgctttagacatctggggccaagggacagtggtcaccgtctcttcag

SEQ ID NO: 2645 - DNA, 370 bp, Artificial Sequence
  Synthetic construct
caggtgcagctggtgcagtctggggctgaggtgaagaagcctggggcctcagtgaaggtctcctgtaaggcttctggatacaccttcaccgcctactacatacactgggtgcgacaggcccctggacaagggcttgagtggatgggatggatcaaccctgacagtggtgacacatactttgcacagaagtttcaaggcagggtcaccatgaccagggacacgtccatcagcacagtctacatggggctgagcagcctgagatctgacgacacggccgtctattactgtgcgaaacctccgggtaagggagcagtggctggcacctactttgactactggggccagggaaccctggtcaccgtctcctcag

SEQ ID NO: 2646 - DNA, 361 bp, Artificial Sequence
  Synthetic construct
caagtgcaactggtgcagtctggggctgaggtgaagaagcctggggcctcagtgaaggtctcctgcaaggcttctggatacacctacagcggctactatatacactgggtgcgacaggcccctggacaggggcttgagtggatgggatggatcaaccctaacagtggtgtcacaaactatgcacagaagtttcagggcagggtcaccatgaccacagacacgtccatcagtacaacctacttggggctgaggacactgagatctgacgacacggccatattttattgtgcgagagatagttgtagtggtggaagttgctatgactactggggccagggaaccctggtcaccgtctcctcag

SEQ ID NO: 2647 - DNA, 361 bp, Artificial Sequence
  Synthetic construct
caggtacagctggtgcagtctgggtctgagttgaagaagcctggggcctcagtgacggtttcctgcaaggcttctggatacaccttcacaaactatgctatacagtgggtgcgacaggcccccggacaggggcttgagtggatgggatggatcaacaccgaccttgggaccccaacgtatgcccagggcttcacaggacgatttgtcttctccttggacacctccgccactacggcatatctgcagatcaccagcctcaagcctgaggacaccgccgtatattactgcgcgagacagggtctcggtggtcgggcctcgggagactcctggggccagggaaccttggtcaccgtctcctcag

SEQ ID NO: 2648 - DNA, 373 bp, Artificial Sequence
  Synthetic construct
caggtgcagctggtgcagtctggggctgaggtgaaggagcctggggcctcagtgaaggtctcctgcaaggcttctggatacaccttcatcggctattatatacattggatacgacaggcccctggacaaggccttgagtggatgggttggatcaaccctagcactggtggctcaaagtatgcacagaaatttcagggccgtgtcaccatgaccagggacacgtccatcagcactgcctacatggatataagcagactgacatctgacgacacggccatatattactgtgcgagatctccacctgcttatgccaactcaataaacaactggttcgacccctggggccagggaaccctggtcaccgtctcctcag

SEQ ID NO: 2649 - DNA, 361 bp, Artificial Sequence
  Synthetic construct
caggtgcaactggtgcagtctggggctgaggtgaaggagcctggggcctcagtgaaaatttcctgcaaggcatctggctacactttcatcgataaccctatacattggattcgacaggcccctggacaaggactggagtggatggggatatacactcccaacggtggcagtacatactacgcacagaggttcgaggacagagtcaccatgaccgcagacgcgtccactaatacacttttcatggaattgagcagcctgagatctgacgacacggccatatatttctgtgcgagagataatagtactgggtggtattggtttgatccctgggggcagggaaccctggtcaccgtctcctcag

SEQ ID NO: 2650 - DNA, 364 bp, Artificial Sequence
  Synthetic construct
caggtccaccttctgcagtctggggctgaggtgaagaagcctggggcctcagtgaaggtttcctgcgaggcttctggattcaccctcagtgactctgttatacattggctgcgccaggcccccggacaaagccctgaatggatgggatggatcaacaagtataatggtgacaagaaaatttcacagagcttgcagggcagagtcaccttgacagcggacacatccgcgaccacatcttacatggagctgagcagcctgacacttgaagacacggctttgtactactgtgcgaggggggaccggagcgtttaccccaactggttcgacctctggggccagggaacccaggtcaccgtctcctcag

SEQ ID NO: 2651 - DNA, 364 bp, Artificial Sequence
  Synthetic construct
caggaacttttgatacagtctggggctgaggtgaagaagcctggggcctcagtgagggtctcctgcgcggcttctggatacaccttcaccggctactacatacattgggtgcgactggcccctggacagagacttgagtggctggggtggatcgaccctcacagtggtgccacagactttgcacagaagtttcgggacagggtcaccatgaccacggacacgtccatcaccacagcctacctggacgtgaccagactgacatctgacgacacggccatttatttctgtgcgagagccctctacggtggtcggggacactggttcgacccctggggccagggatccctggtcaccgtctcctcag

SEQ ID NO: 2652 - DNA, 349 bp, Artificial Sequence
  Synthetic construct
caggtccagcttgtgcagtctggggctgaggtgaagaagcctggggcctcagtgaaggtttcctgcaaggcttctggagacgccttcagttatggtatacattgggtgcgccaggcccccggacaaaggcttgagtgcatgggatggatcaacgctggcaatggttacacaaaatattcacagaacttccaggacagagtcgcctttaccagggacacatccgcgagcactgcctacatggaactgagcagcctgaggtctgaagacacgggtatctattactgtgcgagactggactttcggggagtcctccgctggggccagggaactctggtcaccgtctcctcag

SEQ ID NO: 2653 - DNA, 376 bp, Artificial Sequence
  Synthetic construct
caggtccaacttgtgcagtctggggctgaggtggagaagcctggggcctcggtgaaggtttcctgcaaggcttctgcatacaccttcagtaactatgctatacattgggtgcgccaggcccccggacaaaggcttgagtggatgggatggatcaaccctggcaacggtaacacaagatattcacagaatttccagggcagactcaccatgaccagggacacatccgcgaggacagcctacatggagctgagcagcctgacaattgaagacacggctgtgtattattgtgcgagagacttaacggaagtggtgggagcttctgtttccgatgcttttgatatctggggccaagggacaatggtcaccgtctcttcag

SEQ ID NO: 2654 - DNA, 382 bp, Artificial Sequence
  Synthetic construct
caggtccagcttgtgcagtctggggctgaggtgaagaagcctggggcctcagtgaaggtttcctgcaaggcctctggatacaccttcattagctatgctatacattgggtgcgccaggcccccggacaaaggcttgagtggatgggttggatcaacgctggcaatggtaacacaaaatattcacagaccttccaggacagagtctccatcaccacggacacatccgcgaggacagcctacatggagctgagcagcctgagatccgaagacacggctgtgtattactgtgcgagaggatccttggcttatgatactagtggttattactaccgcaacttcttcgacccctggggccagggaaccctggtcaccgtctcctcag

SEQ ID NO: 2655 - DNA, 390 bp, Artificial Sequence
  Synthetic construct
caggtgcagctggtgcagtctgtggctgaggtgaagaagcctggggcctcagtgaaggtctcctgcaaggcttctggatacaccttcaccggctactttatacattgggtgcggcaggcccctggacaggggcttgagtggatgggatatatcaaccctaacagtggtagcacaaactatgcacagaagtttcagggcagggtcaccgtgaccagggacacgtccatcagcacagcctacatggagctgagcagtctgcgatttgacgacacggccgtatattactgtgcgagagttcgctacgatttttggagtggttatgagggccggggggaggaccactatcacatggacgtctggggcaaagggaccacggtcactgtctcctca

SEQ ID NO: 2656 - DNA, 361 bp, Artificial Sequence
  Synthetic construct
gaggtccagctgatacaatccggggctgaggtgaagaagcctgggacgaccgtgaaagtctcctgcaagacgtctggatactccttcaccgactaccccatagactggatacaacaggcccctggaaaagggcttgagtggatgggacgtgtggatcctcaagatggtgaaagatcatatgcagagagattccagggaagagtcacctttgccgtcgacacgtcaacagacacagtctacatggatttgaagggcctgagatccgaggacacggccgtttattattgtgtgacagatagcgcagggagcccctatgcctttgatatttggggccaggggacaacactcaccgtctcttcag

SEQ ID NO: 2657 - DNA, 367 bp, Artificial Sequence
  Synthetic construct
gaggtccggctggcacagtccggggctgaggtgaagaagcctggggccaccatgaaaatctcctgcaaggcttctggatacattttcaccgactactacatatactgggtgcgacaggcccctggaaaaggacttgagtcgatgggacgtgttgatcctgaggatggtaaaacgatatatggagggaagtttcagggcagaatcaccataaccgcagacacgtctacagacacaacctacatggaactgagcagcctgacatctgaagacacggccgtctattattgtgcaacaaaaggaggattttccaattctcggggagttatgaacttctggggccagggaaccctggtcacagtctcctcag

SEQ ID NO: 2658 - DNA, 355 bp, Artificial Sequence
  Synthetic construct
caggtccagcttgtgcagtctggggctgaggtgaagaagcctggggcctcagtgaaggtttcctgcaaggcttctgaatacatcttcagtaactatgttatatattgggtgcgccaggcccccggacaaaggcttgagtggatgggatggatcaacgctggcaatggtgacacaaaatattcacagatgttccaggacagagtcaccattaccagggacacatccgcgaacacagcctacatggaattggccagcctgagatctgaggacagggcgatatatttctgtgcgagagggggccgatgggatgcttttgatatctggggccaggggacactggtcaccgtctcttcag

SEQ ID NO: 2659 - DNA, 370 bp, Artificial Sequence
  Synthetic construct
caggtgcagctggtgcagtctggggctgaggtgaagaagcctggggcctctgtgaaggtctcctgcaaggcttctggatacaccttcaccaaccatgatatcaactgggtgcgacaggccactggacaagggcttgagtggatgggatacgtgaaccctgacagtggtgccacaggctatgcacagaagttccagggcagagtcaccattaccaggaacacctccataagcgcagccttcatggagctgagcagcctgacacctgaggacacggccgtgtattactgtgcgagagacctcccctatacatattgtggtgatgactgctattccctctggggccagggaaccctggtcaccgtctcctcag

SEQ ID NO: 2660 - DNA, 372 bp, Artificial Sequence
  Synthetic construct
caggtgcagctggtgcaatctggggctgaggtgaagaagcctggggcctcagtgaaggtctcctgcaaggcttctggatacacgttcaccaactatgatatcaactgggtgcgacaggccactggacaagggcttgagtggatgggatggatgaaccctaacagtggtaacacaggctatgcacagaagttccagggcagagtcaccatcaccaggaacaactccataggcacagcctatatggagctgagcagcctgagatctgaggacacggccgtatattattgtgcgaggggcaagcagctcgtccggttccactactactactacatggacgtctggggcaaagggaccacggtcaccgtctcctca

SEQ ID NO: 2661 - DNA, 390 bp, Artificial Sequence
  Synthetic construct
caggtgcagctggtgcagtctggggctgaggtgaagaagcctggggcctcagtgaaggtctcctgcaaggcttctggatacaccttcaccagctatgatatcaactgggtgcgacaggccactggacaagggcttgagtggatgggatggatgaaccctaacagtggtaacacaggctatgcacagaagttccagggcagagtcaccattaccaggaacacctccataagcacagcctacatggagctgagcagcctgagatctgaggacacggccgtgtattactgtgcgagaggcaaagggcttgattacgatattttgactggttgggggtggtactactactacatggacgtctggggcaaagggaccacggtcaccgtctcctca

SEQ ID NO: 2662 - DNA, 384 bp, Artificial Sequence
  Synthetic construct
caggtgcagctggtgcagtctggggctgaggtgaagaagcctggggcctcagtgaaggtctcctgcaaggcttctggatacaccttcaccagctatgatatcaactgggtgcgacaggccactggacaagggcttgagtggatgggatggatgaaccctaacagtggtaacacaggctatgcacagaagttccagggcagagtcaccattaccaggaacacctccataagcacagcctacatggagctgagcagcctgagatctgaggacacggccgtgtattactgtgcgagaggctctagtggttcggggagttattatagctactactactactactacatggacgtctggggcaaagggaccacggtcaccgtctcctca

SEQ ID NO: 2663 - DNA, 361 bp, Artificial Sequence
  Synthetic construct
caggtgcagctggtgcagtctggggctgaggtgaagaagcctggggcctcagtgaaggtctcctgcaaggcttctggatacaccttcaccagctatgatatcaactgggtgcgacaggccactggacaagggcttgagtggatgggatggatgaaccctaacagtggtaacacaggctatgcacagaagttccagggcagagtcaccattaccaggaacacctccataagcacagcctacatggagctgagcagcctgagatctgaggacacggccgtgtattactgtgcgagatcggattactatgatagtagtggttatggtctctggggccagggaaccctggtcaccgtctcctcag

SEQ ID NO: 2664 - DNA, 358 bp, Artificial Sequence
  Synthetic construct
caggtgcagctggtgcagtctggggctgaggtgaagaacactggggcctcagtgaaggtctcctgcaaggcttctggatacaacttcgtcagctatgatatcaactgggtgcgacaggccactggacaagggcttgagtgggtgggatggatgaaccctaatagtggtaacacaggctatgcagagaacttccagggcagagtcaccattaccaggaacacctccataagcacagcctacctggaggtgagcagcctaagatctgaggacacggccgtctattactgtgcgcgagggactatgatcgcgaaaaactttgactcctggggccagggcaccctggtcaccgtctcctcag

SEQ ID NO: 2665 - DNA, 373 bp, Artificial Sequence
  Synthetic construct
caggtgcagctggtgcagtctggggctgaggtgaagaagcctggggcctcagtgagggtctcctgcgaggcttctggatacacctttctcaactatgatatcaactgggtgcgacaggccactggacaagggcttgtctggatgggatggatgaaccctaaaagtggtaacacaggctatgcacagaagttccgcggcagagtcaccattaccaggaacacctctacaaacacgacctacatggagctgaccagcctgacatctgacgacacggccgtgtattactgtgcgagagccggtcggaggccgccctttagtaaccaccctaattttgactcttggggccagggaaccctggtcaccgtctcctcag

SEQ ID NO: 2666 - DNA, 366 bp, Artificial Sequence
  Synthetic construct
caggtgcagctggtgcagtctggggctgaggtgaagaagcctggggcctcagtgaaggtctcctgcgaggcttctggatacaccttcactagctttgatatcaactgggtgcgacaggccagtggacaggggcttgagtggatgggatggatgaaccctaagagtggtgacacaggctatgcacagaagttccagggcagactcaccatttccagggacacctccataagcacagcctacatggagctgagcaacctgagatctgaggacacggccgtgtattactgcgtcgctcggagtcccccagcctacttctactactacatgaatgtctggggcaatgggaccacggtcaccgtctcctca

SEQ ID NO: 2667 - DNA, 358 bp, Artificial Sequence
  Synthetic construct
caggtccagctggtgcagtctggggctgaggtgaagaagcctgggtcctcggtgaaggtctcctgcaaggcttctggagacaccttcagcagttttgctatcaactgggtgcgacaggcccctggacaagaacttgagtggatgggaggcatcatccctatccttggcacatcaaactacgcacagaactttcagggcagagtcacaatcaccacggacgaatccacgagcacaacctacatggagctgagcagcctgagatctgaggacacggccgtgtatttttgtgcgaggacaaattacggtgaccaatattttgactactggggccagggaaccctggtcaccgtctcctcag

SEQ ID NO: 2668 - DNA, 376 bp, Artificial Sequence
  Synthetic construct
caggtccagttggtgcagtctggggctgaggtgaagaagcctgggtcctcggtgaaggtctcctgccaggcttctggaggcaccttcagtagtgatgctatcaactgggtgcgacaggcccctggacaagggcttgagtggatgggagggattgttccgatgtttggaacaactaactacgcacggaagttccagggcagagtcacgattaccgcggacgaatccacgaacacagtctacatggacttgcgcagcctgacgtctgaagacacggccacatacttctgtgcgagagcgccggggattgtggcggtcagagccacggagggctggtacgacccctggggccagggaaccctggtcaccgtctcctcag

SEQ ID NO: 2669 - DNA, 373 bp, Artificial Sequence
  Synthetic construct
caggtgcagctggtgcagtctggggctgaggtgaagaagcctggggcctcagtgaaggtctcctgcaaggcttctggatacaccttcaccagctatgatatcaactgggtgcgacaggcccctggacaagggcttgagtggatgggatggatgaaccctaacagtggtaacacaggctatgcacagaagttccagggcagagtcaccattaccagggactcctccataagcacagcctacatggatctgagcagcctgagatctgaggacacggccgtgtattactgtgcgagagaggtcggttgtagtggtattaactgccagggctggttcgacccctggggccagggaaccctggtcaccgtctcctcag

SEQ ID NO: 2670 - DNA, 385 bp, Artificial Sequence
  Synthetic construct
caggttcagctggtgcagtctggagctgaggtgaagaagcctggggcctcagtgaaggtctcctgcaaggcttctggttacacttttaccagctatggtatcaactgggtgcgacaggcccctggacaagggcttgagtggatgggatggatcagcgctgacaatggtaacacaaactatgcacagaagctccagggcagagtcaccatgaccacagacacatccacgaagacagcctacatggagctgaggagcctgagatctgacgacacggccgtgtattactgtgcgagagagaaaattgggcccaaaacttacgatattttgactggttacactatctttgactactggggccagggaaccctggtcaccgtctcctcag

SEQ ID NO: 2671 - DNA, 364 bp, Artificial Sequence
  Synthetic construct
caggtccagctggtgcagtctggggctgaggtgaagaagcctgggtcctcggtgaaggtctcctgcaaggcttctggaggcaccttcagcaactatgctatcaactgggtgcgacaggcccctggacaaggtcttgagtggatgggagggatcatccctatctttgctacagcaaactacgcacagaagttccagggcagagtcacgattaccgcggacgaatccatgaacacagtctacatggagctcagcagcctgagatctgaagacacggccgtctattattgtgcgagaggggggtatgattacctttgggggagtcatgggtactggggccagggaaccctggtcaccgtctcctcag

SEQ ID NO: 2672 - DNA, 370 bp, Artificial Sequence; identical to SEQ ID NO: 1766
  Synthetic construct

SEQ ID NO: 2673 - DNA, 376 bp, Artificial Sequence
  Synthetic construct
caggtgcagctggagcaatctgggtctgagtttaagaagcctggggcctcagtgaagatttcctgcaaggcttctggatacagtttcacgacctatgctatcaattgggtgcgacaggcccctggacaaggacttgagtttatgggatggatcaaccccaacagtggaaagccaacctatgcccaggacttcacaggacggtttgacttctccttggattcctctgcgagcacggcatatctgcagatcagcagtctccaggctgacgacactgccatctattactgtgcgagagatctatggtatgattttgatagcagtgctgcggggtcccttgacgactggggccagggaaccctggtcaccgtctcctcag

SEQ ID NO: 2674 - DNA, 346 bp, Artificial Sequence
  Synthetic construct
caggtccagttggtgcagtctggggctgaggtgaagaagcctgggtcctcggtgaaggtctcctgcaaggcttctggaggcaccttcagcagctattctatcacctgggtgcgacaggcccctggacaagggcttgagtggatgggaaagatcttctttcaaacacccacctacgcacagaaattccagggcagagtcacctttaccacggacgtgtctacgagtacagactacctggagctgagcagcctgagatctgacgacacggccgtctattactgtgcgacagacctaggagcaccttcggggcactggggccagggaaccctggtcaccgtctcctcag

SEQ ID NO: 2675 - DNA, 367 bp, Artificial Sequence
  Synthetic construct
caggtccagctggtgcagtctggggctgaggtgaagaagcctgggtcctcggtgaaggtctcctgcaaggcttctggaggctccttcagcagctttgctatcacctgggtgcgacaggcccctggacaagggcttgagtggatgggagggatcatccccagctttggaacagcgaactacgcacagaagttgcaggacagagtcacgattaccacggacgaatccacgaccacagcctacatggagctgcgcagcctgacatctgaggacacggccatgtattactgtgcgatagatgtgggggctactgggggggcctactactttgactactggggccagggaaccctggtcaccgtctcctcag

SEQ ID NO: 2676 - DNA, 385 bp, Artificial Sequence
  Synthetic construct
caggtccagctggtgcagtctggggctgaggtgaaggagcctgggtcctcggtgaaggtctcctgcaaggcttctagaggcaccttcagcagctatgctatcacctgggtgcgacaggcccctggacaagggcttgagtggatgggagggatcatccctatctttggtacagcagactacgcacagaagttccagggcagagtcacgattaacacggacgaatccacgagcacagcctacatggaactgagtagcctgagatctgaggacacggccgtctattactgtgcgagatgtcgtgtaggtcggacaagtatgtctcagcccctaatcggggctgcttttgatatctggggccgagggacaatggtcaccgtctcttcag

SEQ ID NO: 2677 - DNA, 352 bp, Artificial Sequence
  Synthetic construct
caggttcacctggtgcagtctggcgctgaagtgaagaagcctggggcctcagtgaaagtctcctgcaagacttctggttacacctttaccgactatggtatcacctgggtgcgacaggcccctggacaagggcttgagtggatgggatggatcagcgcttccactgcgaacacaaagtatgcacagaagttccaggacagagtcaccttgaccaccgacacatcttcgagcacagcctacatggaactgagggagttgagagttgacgacacggccctgtattattgtgcgagagcaaggtacactgtggatgactactggggccagggaaccctggtcaccgtctcctcag

SEQ ID NO: 2678 - DNA, 390 bp, Artificial Sequence
  Synthetic construct
caggttcagctggtgcagtctggagctgaggtgaagaagcctggggcctcagtgaaggtctcctgcaaggcttctggttacacccttaacaactatggtatcacctgggtgcgacaggcccctggacaagggcttgagtggatgggatggatcagcggtaataatgataacacaaactatgcacagaagttccagggcagagtcgccttgaccacagacacatccacgagcacagcctacatggagctgaggagcctgagatctgacgacacggccgtgtattactgtgcgagagatggaaattacgatttttggagtggttataacccttttgggtactaccactacatggacgtctggggcaaagggaccacggtcaccgtctcctca

SEQ ID NO: 2679 - DNA, 366 bp, Artificial Sequence
  Synthetic construct
caggtccagctggtgcaatctggggctgaggtgaagaagcctgggtcctcggttaaggtctcctgcaaggcttctggaggcaccttcagcagccatgctatcacctgggtgcgacaggcccctggacaagggcttgagtggatgggtgggatcatccctttccttgctagagcaaactccgcagagaagttccaggacagagtcacgattaccgcggacgaatccacgagcacagcctacatggagctgagcagcctgagatctgatgacacggccgtgtattactgtgcgagagccccttcggacgcccattactattactatatggacgtctggggcaaagggaccacggtcaccgtctcctca

SEQ ID NO: 2680 - DNA, 382 bp, Artificial Sequence
  Synthetic construct
caggttcagctggtgcagtctggagctgaggtgaacaagcctggggcctcagtgaaggtctcctgtagggcttttggtttcaccatttccagttatggtatcacctgggtgcgacaggcccctggacaggggcttgagtggatgggatggatccgcgctgacattggtgacacaaattatgcacagaagttccaggacagaaccaccatgaccacagacacatccacgaacacagcctacatggagctgaggagcctgagatctgacgacacggccgtatattactgtgcgagggaaaattacattttacgatatttaccggtggcccggcggggcgctgttgatatctggggccaagggacgatggtcaccgtctcctcag

SEQ ID NO: 2681 - DNA, 373 bp, Artificial Sequence
  Synthetic construct
caggttcagctggtgcaatctggaggtgaggtgaagaagcctggggcctcagtgaaggtctcctgcaaggcttctggttacaccttaacaagttatggtatcacctgggtgcgacaggcccctggacaggggcttgagtggctgggatggatcagcctttacaatggtgccacaaactatgcacagaacctccagggcagagtcaccatgaccgcagacacatccacgcgcacagcctacatggaactgaggagcctgagatttgacgacgcggccgtctattactgtgctatcttaacattttacgatattttgagtggcccctactcgtttgacttctggggccagggaaccctggtcaccgtctcctcag

SEQ ID NO: 2682 - DNA, 370 bp, Artificial Sequence
  Synthetic construct
caggtccaactggtgcagtctggggctgaggtgaagaagccggggtcctcggtgaaggtctcctgcaaggctcctggagacaccttcaacaattatgttatcacgtgggtgcgacaggcccctggacaacggcctgagtggatgggggggttcatccccatttttggcacaacgaactacgaacagaagttgcagggcagagtcacgattaccgcggacggatctacgggcacagcctacatggagctgagaaacctgacatatgaggacacggccgtctattattgtgcgagagatggggcccggatagtgggactgactcatgcacttgatatttggggccaagggacagtggtcaccgtctcttcag

SEQ ID NO: 2683 - DNA, 376 bp, Artificial Sequence
  Synthetic construct
caggtgcagctggtgcagtcaggagccgaggtgaagaaaccaggcagctccgtgaaggtcagctgcaaagcttccggggtgacatctagtaactaccccatcacttgggtccgacaggcacctggacagggactggaatggatgggaggagtgctgccactgttcggagtcaccaactacgcccagaagtttcagggaagggtgacaatttctgcagacaaaagtaccaatacagcctatatggagctgtcaagcctgcgctctgaagataccgccgtgtactattgtgctcggggaaagagacccggctactgcagcggaggcgtctgttcctctgaatattggggccaggggactctggtgaccgtctcctcag

SEQ ID NO: 2684 - DNA, 376 bp, Artificial Sequence
  Synthetic construct
caggtgcagctggtgcagtcaggagccgaggtgaagaaaccaggcagctccgtgaaggtcagctgcaaagcttccggggtgacatctagtaactaccccatcacttgggtccgacaggcacctggacagggactggaatggatgggaggagtgctgccactgttcggagtcaccaactacgcccagaagtttcagggaagggtgacaatttctgcagacaaaagtaccaatacagcctatatggacctgtcaagcctgcgctctgaagataccgccgtgtactattgtgctcggggaaagagacccggctactgcagcggaggcgtctgttcctctgactattggggccaggggactctggtgaccgtctcctcag

SEQ ID NO: 2685 - DNA, 376 bp, Artificial Sequence
  Synthetic construct
caggtgcagctggtgcagtcaggagccgaggtgaagaaaccaggcagctccgtgaaggtcagctgcaaagcttccggggtgacatctagtaactaccccatcacttgggtccgacaggcacctggacagggactggaatggatgggaggagtgctgccactgttcggagtcaccaactacgcccagaagtttcagggaagggtgacaatttctgcagacaaaagtaccaatacagcctatatggagctgtcaagcctgcgctctgaagataccgccgtgtactattgtgctcggggaaagagacccggctactgcagcggaggcgtctgttcctctgactattggggccaggggactctggtgaccgtctcctcag

SEQ ID NO: 2686 - DNA, 376 bp, Artificial Sequence
  Synthetic construct
caggtgcagctggtgcagtcaggagccgaggtgaagaaaccaggcagctccgtgaaggtcagctgcaaagcttccggggtgacatctagtaactaccccatcacttgggtccgacaggcacctggacagggactggaatggatgggaggagtgctgccactgttcggagtcaccaactacgcccagaagtttcagggaagggtgacaatttctgcagacaaaagtaccaatacagcctatatggagctgtcaagcctgcactctgaagataccgccgtgtactattgtgctcggggaaagagacccggctactgcagcggaggcgtctgttcctctgactattggggccaggggactctggtgaccgtctcctcag

SEQ ID NO: 2687 - DNA, 376 bp, Artificial Sequence
  Synthetic construct
caggtgcagctggtgcagtcaggagccgaggtgaagaaaccaggcagctccgtgaaggtcagctgcaaagcttccggggtgacatctagtaactaccccatcacttgggtccgacaggcacctggacagggactggaatggatgggaggagtgctgccactgttcggagtcaccaactacgcccagaagtttcagggaagggtgacaatttctgcagacaaaagtaccaatacagcctatatggagctgtcaagcctgcattctgaagataccgccgtgtactattgtgctcggggaaagagacccggctactgcagcggaggcgtctgttcctctgactattggggccaggggactctggtgaccgtctcctcag

SEQ ID NO: 2688 - DNA, 376 bp, Artificial Sequence
  Synthetic construct
caggtgcagctggtgcagtcaggagccgaggtgaagaaaccaggcagctccgtgaaggtcagctgcaaagcttccggggtgacatctagtaactaccccatcacttgggtccgacaggcacctggacagggactggaatggatgggaggagtgctgccactgttcggagtcaccaactacgcccagaagtttcagggaagggtgacaatttctgcagacaaaagtaccaatacagcctatatggagctgtcaagcctgcgctctgaagataccgccgtgtacttttgtgctcggggaaagagacccggctactgcagcggaggcgtctgttcctctgactattggggccaggggactctggtgaccgtctcctcag

SEQ ID NO: 2689 - DNA, 373 bp, Artificial Sequence
  Synthetic construct
caggtccacctggtgcagtctggggctgaagtgaagaagcctgggtcgtcggtaaaggtctcttgcaaggcttctggaggcaccttcagcagtttttccatcagctgggtgcgacaggcccccggccaagggcttgagtggatgggaggggtcatccctatgtttggtgcaacaaacttcgcacagaagttccagggcagagtcacgattagtacggacgacctcgctaggacagtgtacatggagctgagcagcctgagatctgacgacacggccgtatactactgcgcgagacacccggctacatcaatggctggcatgtggggttacattgacacctggggccagggaaccctggtcaccgtctcctcag

SEQ ID NO: 2690 - DNA, 372 bp, Artificial Sequence
  Synthetic construct
caggttcaacttgtgcagtctggagctgaggtgaagaagcctggggcctcagtgaaggtctcctgtaaggcttctggttacaccttcaccaactttggtatcagctgggtgcgacaggcccctggacaaggccttgagtggatgggatggatcaactcttacaatggtaacacaaactatgcacagaatctgtacgacagagtcagcatgaccacagacacaaccacgaacacagccgacatggagctgaggagcctgacatctgacgacacggccgtgtattactgtgcgagagtggtgggcgtccgacactgggagcagttctactacatggacgtctggggcaaagggaccacggtcaccgtctcctca

SEQ ID NO: 2691 - DNA, 346 bp, Artificial Sequence
  Synthetic construct
caggtccaactggtgcagtctggggctgaggtgaagaagcctgggtcctcggtgaaggtctcctgcaaggcttctggaggcaccttcagcagttttgctatcagctgggtgcgacaggcccctggacaagggctcgagtggatgggagggctcacccctatttttggaactgctaactatgcacagaagtttcagggcagagtcacgattaccgcggacgaatcttcgagcacagtctacattgaagtgagcagactgagatctgaggacacggccgtgtattactgtgtgagacgcccctggttcgacccctggggccagggaaccctggtcaccgtctcctcag

SEQ ID NO: 2692 - DNA, 391 bp, Artificial Sequence
  Synthetic construct
caggtccagttggtgcagtctggggctgaggtgaagaagactgggtcctcggtgaaggtctcctgcaaggcctctggaggcatgttcaattcctatgctatcagctgggtgcgacaggcccctggacaagggcttcagtggatgggagggatcatccctctctttggtacaacaacttatgcacaagagttccagggcagagtcacgattaattcggacgaatccacgaccacagcctttatggaactgaacagcctgagatctgaggacacggccgtgtattactgtgcgacagagggcaaaggcgcaagtaaggcatattgtggggatgagtgctccttctcattctttgaccagtggggccagggaaccctggtcatcgtctcctcag

SEQ ID NO: 2693 - DNA, 381 bp, Artificial Sequence
  Synthetic construct
caggtccagctggtgcagtcaggggctgaggtgaagaagcctgggtcctcggtgaaggtctcctgcaaggcttctggaggcaccttcagcagctatgcaatcagctgggtgcgacaggcccctggacaagggcttgagtggatgggagggatcatccctctctttggttcaggaaactacgcgcagaagttccagggcagagtcacgataaccgcggacgtatccacgaatacagtctacatggagatcagcagcctgagatctgaggacacggccgtgtattactgtgcgagcctagatgaaagacgaggatacagctatggttaccacttctattacatggacgtctggggcaaagggaccacagtcaccgtctcctca

SEQ ID NO: 2694 - DNA, 376 bp, Artificial Sequence
  Synthetic construct
caggtccagctggtgcagtctggggctgaggtgaagaagcctgggtcctcggtgaaggtctcctgcaaggcttctggaggcaccttcagcaactatgctatcagctgggtgcgacaggcccctggacaagggcttgagtggatgggagggatcatccctatctttggtacaacaaactacgcacagaagttccagggcagagtcacgattaccacggacgaatccacgagcacagcctacatggagttgagcagcctgagatctgaggacacggccgtgtattactgtgcgagagacttaggtatagcagtggctggtaagagggacgatgcttttgatatctggggccaagggacaatggtcaccgtctcttcag

SEQ ID NO: 2695 - DNA, 378 bp, Artificial Sequence
  Synthetic construct
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggacgaatccacgagcacagcctacatggagctgagcagcctgagatctgaggacacggccgtgtattactgtgcgagagagcaaggtcccgaatatagtgggagctactactactactacatggacgtctggggcaaagggaccacggtcaccgtctcctca

SEQ ID NO: 2696 - DNA, 373 bp, Artificial Sequence
  Synthetic construct
caggtccagctggtgcagtctggggctgaggtgaagaagcctgggtcctcggtgaaggtctcctgcaaggcttctggaggaaccttcagcagctatagtatcagctgggtgcgacaggcccctggacaagggcttgagtggatgggagggatcatcgctgtctttggtacaccagagtacgcacagaagttccagggcagagtcacgattaccacggacgaatccacgagcacagcctacatggacctgagtagcctgagatctgaggacacggccgtgtatttctgtgcgttcagcgattactctgatagtagcggctattacttcttttttgactactggggccagggaaccctggtcaccgtctcctcag

SEQ ID NO: 2697 - DNA, 393 bp, Artificial Sequence
  Synthetic construct
caggtccagctggtgcagtctggggctgaggtgaagaagcctgggtcctcggtgaaggtctcctgcacggcttctggaggcacctttagcagttatgctatcagctgggtgcgacaggcccctggacaagggcttgagtggatgggagggatcatccctatgtctggtacagccaactacgcacagaagttccagggcagagtcacgattaccacggacgaatccacgaagacagcctacatggagctgagcagcctgagatctgaggacacggccgtgtattactgtgcgagaccctcgggtagggattactctcgttatggttcgggggggcgaaacttctactactacatggacgtctggggcaaagggaccacggtcaccgtctcctca

SEQ ID NO: 2698 - DNA, 376 bp, Artificial Sequence
  Synthetic construct
cagattcagctggtgcagtctggaggtgaggtgaagaagcctggggcctcagtgaaggtctcctgcaaggcttctggttacacctttaggaactatggtatcagctgggtgcgacaggcccctggacaagggcttgagtggatgggatggatcagcgcttacaatggtgacacagtctatgcacagaacctccagggcagagtcaccgtgaccgtagacacatccacgagcacagtctacatggagctgaggagccttagatctgacgacacggccgtctattactgtgcgagagacggggagtattgtggtactgcctgctccatcaactggttcgacccctggggccagggaaccctggtcagtgtctcctcag

SEQ ID NO: 2699 - DNA, 364 bp, Artificial Sequence
  Synthetic construct
caggttaagatggtgcagtctggagctgaggtgaagaagcctggggcctcagtgaaggtctcctgcaaggcttctggttacagcttttccagttatggtatcagctgggtgcgacaggcccctggacaagggcttgagtggatgggatggatcagctacaatggtaatataaactatggacagaaattccagggcagagtcaccatgaccacagacacatcgacgagtacagcctacatggaactgaggagcctgagatctgacgacacggccgtgtattattgtgcgagagatttccaggcgtcgatggtgagtcctagggtcgcctactggggccagggaaccctggtcaccgtctcctcag

SEQ ID NO: 2700 - DNA, 355 bp, Artificial Sequence
  Synthetic construct
caggttcagctggtgcagtctggagctgaggtgaagaagcctggggcctcagtgaaggtctcctgcaaggcctctggttacagctttaccaactatggtatcagctgggtgcgacaggcccctggacaagggcttgagtggatgggatggatcagcgcttacaatggtaacacaaactatgcacagaaggtccagggcagagtcaccatgaccacagacacatccacgagcacagcctatatggagctgagtagcctgagatctgacgacacggccgtgtattactgtgcgagagccgactacggttcctctctggacgtctggggcaaagggaccacggtcaccgtctcctcag

SEQ ID NO: 2701 - DNA, 373 bp, Artificial Sequence
  Synthetic construct
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagattcagtagtaccagctgctatggagggcaactggttcgacccctggggccagggaaccctggtcaccgtctcctcag

SEQ ID NO: 2702 - DNA, 355 bp, Artificial Sequence
  Synthetic construct
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagctgaccttaatggtgcttttgatatctggggccaagggacaatggtcaccgtctcttcag

SEQ ID NO: 2703 - DNA, 361 bp, Artificial Sequence
  Synthetic construct
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaggggaagtgggagctacggtccggtttgactactggggccagggaaccctggtcaccgtctcctcag

SEQ ID NO: 2704 - DNA, 391 bp, Artificial Sequence
  Synthetic construct
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagtcgtaaagggaaaacagtattacgatattttgactggttattatgagaactggttcgacccctggggccagggaaccctggtcaccgtctcctcag

SEQ ID NO: 2705 - DNA, 381 bp, Artificial Sequence
  Synthetic construct
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagatctgaacatccctttgactggttattctgttgcgactactactacatggacgtctggggcaaagggaccacggtcaccgtctcctca

SEQ ID NO: 2706 - DNA, 358 bp, Artificial Sequence
  Synthetic construct
caggttcagctggtgcagtctggaggtgaggtgaagaagcctggggcctcagtgagggtctcctgcaaggcttctggttacacctttaccagctatggtatcagctgggtgcgacaggcccctggacaagggcttgagtgggtgggatggatcaacacttactatggtcacacaaactatgcacagaaactccagggcagagtcaccatgaccacagacacatccacgagtacagcctacatggagctgacgagcctgaaatctgacgacacggccgtgtattactgtgcgagagtatcgcccgcgacaatgcgggcagtctactggggccagggaaccccggtcaccgtctcctcag

SEQ ID NO: 2707 - DNA, 388 bp, Artificial Sequence
  Synthetic construct
caggtccagctggtacaatctggggctgaggtgaagaagccggggtcctcggtgaaggtctcctgcacggcttctggaggcgccttcagtgcctattcaatcagctgggtgcgacaggcccctggacaaggtcttgagtggatgggagggatcatccctctctttggtgcaccaaattatgcagtgaatttccaggacagagtcaccctcaccacggacgaatccacgaacactgcctacatggaactgagcgaccttaaatctgacgacacggccgtctatttctgtgcggaggactcattttgtggtgatgactgctctcgataccagactcggaggggggcttttaatgtctggggccaagggacagtagtcaccgtctcttcag

SEQ ID NO: 2708 - DNA, 361 bp, Artificial Sequence
  Synthetic construct
caggttcagctggtgcagtctggagctgaggtgaagaagcctggggcctcagtgaaggtctcctgcaaggcttctggttacacttttaccagttatggtatcagctgggtgcgacaggcccctggacaaggtcttgagtggatgggatggatcagcgcttacaatggtgacacaaactatgcacagaaactccagggcagagtcaccatgaccacagacacatccacgagcacggcctacatggagctgaggagcctgagatctgacgacacggccctgtattactgtgcgagaggggattactttgatagtatcggtttacggtactggggccagggaaccctggtcaccgtctcctcag

SEQ ID NO: 2709 - DNA, 358 bp, Artificial Sequence
  Synthetic construct
caggtccaactggtacaatctggggctgaggtgaagaagcctgggtcctcggtgaaagtctcctgcaaggcttccggaggcgccttcagtaggtatgttatcagctgggtgcgacaggcccctggacaggggcttgagtggatgggaaacatcatctgtatctctgaagcaccagagtacgcacagagtttccaggacagactcacgattacggcggacaagtccacgaacaccgtgtacatggacttgagtagcctgacatctgaggacacggccgtttacttctgtgcgagggaatcgggaggcttttcgggttttgacttctggggccagggaacccgggtcaccgtctcctcag

SEQ ID NO: 2710 - DNA, 349 bp, Artificial Sequence
  Synthetic construct
caggtccagctggtgcagtctggggctgaggtgaagaagcctgggtcctcggtgaaggtctcctgcaaggcttctggaggcaccctcgggaactatgctatcagctgggtgcgacaggcccctggacaggggcttgagtggctgggagggatcatccctatctttgctacaacacactacgcacagaagttccagggcagagttacgattaccgcggacgaatccacgagcacagcctacatggagctgaccagcctgacatctgaagacacggccctttattactgtgcgagagaagtagggtggttcgacccctggggccagggaaccctggtcaccgtctcctcag

SEQ ID NO: 2711 - DNA, 364 bp, Artificial Sequence
  Synthetic construct
caggttcagctggtgcagtccggagctgaggtgaagaagcctggggcctcagtgagggtctcctgcacggcctctggttatagcttttccagttttggcatcagctgggtgcgacaggcccctgggcaagggcttgagtggatgggatggattagcggtgacaatggcaacacaaattatgcacagaggatccaggacagagtcaccatgaccacagacacatcaacggacacagtctacatggacttgaggagcctgacatctgacgacacggccgtctattactgtgcgagagaatcctcgttcgggtgggacaatgtcttggacctttggggccagggaaccctggtcaccgtctcctcag

SEQ ID NO: 2712 - DNA, 370 bp, Artificial Sequence
  Synthetic construct
caggtccagttggtgcagtctggggctgaggtgatgcagcctgggtccgcggtgaaggtctcctgcgaggcttctggaggcaacttcaacaaccttgttatcagctgggtgcgacaggtccctggacaagggcttgagtggatgggagggatcatcccgatctttggtacggtgaactacgcacagaagttccggggcagagtcacgataaccaaggacgaatccacgagcacagcctacatggagctgagcagcctgagatatgaagacacggccgtctattactgtgcaaatttattttgtgggggtggtaggtgctattccctgtttgactactggggacagggaaccctggtcgccgtctcctcag

SEQ ID NO: 2713 - DNA, 375 bp, Artificial Sequence
  Synthetic construct
caggtccagttggtgcagtctggggctgaggtgatgcagcctgggtccgcggtgaaggtctcctgcgaggcttctggaggcaacttcaacaaccttgttatcagctgggtgcgacaggtccctggacaagggcttgagtggatgggagggatcatcccgatctttggtacggtgaactacgcacagaagttccggggcagagtcacgataaccaaggacgaatccacgagcacagcctacatggagctgagcagcctgagatatgaagacacggccgtctattactgtgcgaagagatctgggtgggagtacggggggcgttcttcgtactacatggacgtctggggcagcgggaccacggtaatcgtctcctcg

SEQ ID NO: 2714 - DNA, 364 bp, Artificial Sequence
  Synthetic construct
caggtccagctggtgcagtctggggctgaaatgaagaagcctgggtcctcggtgaaggtctcctgcaaggcctctggaggcaccttcagcacctctggaatcagctgggtgcgccaggcccccggacaagggcttgagtggatgggaggaatcatccctatccatggtacagtggataaggcacagaagttccagggcagagtcacatttaccgcggacgactccacgagcacggcctacatggaattgagcagcctgagatctgaagacacggccgtctattactgtgcgagagatcaggggatacagattcgtgatgcttttgatctctggggccaagggacattgctcaccgtctcttcag

SEQ ID NO: 2715 - DNA, 375 bp, Artificial Sequence
  Synthetic construct
caggttcagttggtgcagtctggaggcgaggtgaggaagcctggggcctcactgaaggtctcctgccaggcttctggctacactttcaatagatacggtatcagctgggtgcggcaggcccctggacaagggcttgagtggctgggctggataagcgcttacgacgggcgcacaacttacgcagagaagtttaagggcagagtcaccttgaccacagacacatccacgaccacagcctacatggaactgaggagcctgagatctgacgacacggccatatacttctgtgcgagagaggcagttacggttcggggaattggcttctactaccacatggacgtctggggcaagggggcctcggtcaccgtctcctca

SEQ ID NO: 2716 - DNA, 367 bp, Artificial Sequence
  Synthetic construct
caggtgcagctggtgcagtctggggctgaggtgaagaagcctgggtcctcggtgaaggtctcctgcaaggcttctggaggcaccttcagcaactctgctatcagctgggtgcgtcaggcccctggacgagggcttgaatggatgggagggatcatccccatctttggaacaacaaacaacgcacagaaattccaggccagagtcacccttaccgcggacgaagcaacgaacacagcctacatggagctgagcagcctccaatttgaggacactgccatatattactgtgcgagaggcctagtgggacctcctatttcttcgtacctcgatctctggggccgtgggaccctggtcactgtctcctcag

SEQ ID NO: 2717 - DNA, 385 bp, Artificial Sequence
  Synthetic construct
caagttgagatggtacagtcaggagctgaggtgaagaagcctggggcctcagtgaaggtctcctgcaaggcttctggttacacctttaccaactatggtatcagttgggtgcgacaggcccctggacaagggcttgagtggatgggatggatccgcccttacaatggtcagacaaactatgtccagagtctccagggcagagtcacaatgaccacagacacagccacgaacacagcctacatggagctgaggagcctgcgatctgacgacacggccgtctatttctgtgcgagaacatattgtggtggtgattgctatttgaggggttggatccctgtttcttttgatatctggggccaagggacaatggtcaccgtctcttcag

SEQ ID NO: 2718 - DNA, 364 bp, Artificial Sequence
  Synthetic construct
caggttcagctggtgcagtctggagctgaggtgaagaagcctggggcctcagtgaaggtctcctgcaaggcttctggttacacctttatcaactatggtatcagttgggtgcgacaggcccctggacaagggcttgagtggatgggatggataaccacttacaatggtaacacaaactatgcacagaggctccagggcagagtcaccatgaccacagatacatccacgaacacagcctacatggagctgaggagcctgagatctgacgacacggccgtgtattactgtgcgagagactccaaacgtattagtctgtctcaggaagactactggggccagggaaccctggtcaccgtctcctcag

SEQ ID NO: 2719 - DNA, 370 bp, Artificial Sequence
  Synthetic construct
caggtccagctggtgcagtctggggctgaggtgaagaggcctgggtcctcggtgacgatctcctgcaagacttctggaggcaccttcggctcctatgcaatcatctgggtgcggcaggcccctggacaaggccttgagtggatgggaggaatcatccctatctttggtactccacactacgcgcaggacttccagggcagagtcaccattacttcggacgaatcgacgagctcagcctacatgcagttgagcagcctcaggtctgacgacacggccgtatacttctgtgcgagagccgccgagtcggctacatctactcactggtacttcgatctctggggccttggcacccaggtcactgtcgcctcag

SEQ ID NO: 2720 - DNA, 358 bp, Artificial Sequence
  Synthetic construct
caggtgcagttgctgcaatctgggtctgaggtggagaggcctggggcctcagtgaaggttgcctgcaaggcttccggatacactttcactactcatgcaatcatgtgggtccgacaggcccctggagaaggacttcagtggatgggatggatgaacaccaacactgggcagccaacctatgccccgggcttcagaggacggattgtcttgtccttaaacacttctgtcaattcggcttacctacaaatcgacaacgtaaggcctgaggacactgccgtctatttctgtgcgcgatcaggcggacccgcggcctggctcgacccctggggccagggaacccaggtcaccgtctcctcag

SEQ ID NO: 2721 - DNA, 349 bp, Artificial Sequence
  Synthetic construct
gaggtccaactggtacagtccggggctgaggtgaagaagcctggggccaccgtgaaaatctcctgcaatgcttctggatacacattcaccgactactacatccactggattcaacaggcccctggaaaacgacctgagtggatggcacgtattgatcccgagaatggtgaaacactttttgcagagagtttccatgacagaatcgccataaccgcggacacgtccacagccaccgccttcatggaattgaggagcctgagatctgaggacacggccgtgtattattgtgcgactcttggtgacgaccataattcctggggccagggaaccctggtcaccgtctcctcag

SEQ ID NO: 2722 - DNA, 367 bp, Artificial Sequence
  Synthetic construct
cagctgcagttggtggagtctgggggaggcgtggtccagcctgggaagtcgctgaggctctcctgtgcaggctctggattcagcttcagtgaatttggcatccactgggtccgccaggctcccggcagggggctggagtgggtggcagttatttcatttggtgggagtgatcaatactacgcagactccgttaagggacgattcactttgtccagagacaactccaagagtacagtgttcctgaagatgaacagtctgagaattgaggacacgggtgtgtattactgtgcgaccgtcagggagcgcctcggagtctccgggtgcccagcctactggggccagggaatatcggtcaccgtctcctccg

SEQ ID NO: 2723 - DNA, 384 bp, Artificial Sequence
  Synthetic construct
gaggtccagctggtacagtccggggctgaggtgaagaagcctggggccaccgtgaaaatctcctgtaaggcttctggatacaccttcaccgactacttcatccactgggtgcaacaggcccctggaaaagggcttgagtggatgggacgcattgatcctgaagatggagaaacaaaatatgcagagaagttccggggcagagtcaccataaccgcagacacatctacaaacacagcctacatggaattgagcagcctgagatttgaggacacggccatttattactgtgcaacagatataaaagtccacggtgactacagagggccctacttctactactacatgggcgtctggggcaaagggaccacggtctccgtctcctca

SEQ ID NO: 2724 - DNA, 370 bp, Artificial Sequence
  Synthetic construct
caggtccagctggtgcagtctggggctgaggtgaagaagcctgggtcctcggtgaaggtctcctgcaaggctcctggaggcaccttcagcagctatggtatccactgggtgcgacaggcccctggacaagggcttgagtggatgggagggatcatcccaagttttggagcagcaaagtacggaaagaacatccccgacagagtcacgattaccgcggacgaatcgtcgagcacagcctatttggagatgagctccctgagatctgaagacacggccatttattactgtgcgagagcgtttgtgtatggttcggggagttgggctgcttttgacatttggggcctggggacaacggtcatcgtctcttcag

SEQ ID NO: 2725 - DNA, 367 bp, Artificial Sequence
  Synthetic construct
caggtgcagctggtgcagtctggggctgaggtgaagaagcctggggcctcagtgaaggtttcctgcaaggcatctggagagacgtccagcaactactatatccactgggtgcgacaggcccctggacaagggcttgagtggatgggagtaatcaaccccactggtagaagcacatcctacgcagggaggttccagggcagagtcaccctgaccagggacacgtctagaaacacagtctacatggaactgagcagcctgacttctgaggacacggccgtatattactgtgcgagagatcgcaaagaattcgaaagacgtcactggttcgacccctggggccagggaaccctggtctccgtctccacag

SEQ ID NO: 2726 - DNA, 376 bp, Artificial Sequence
  Synthetic construct
caggtgcagctggtgcagtctgggactgaggtgaagaagactggggcctcagtgaaaatctcctgcaaggcctctggatacaactttattgactactatatccactgggtgcgacaggcccctggacaggggcttgagtggatgggatggatcaaccctaacagtggtgacacaaactatgcacagaagtttcagggcaggatcaccatggccagggacacgtccatcatcacagcctacatggacctgagcaggctgaaatctgacgacacggccgtctattactgtgcgagggtaggggacgataacgatttttggagtggtcattccagctttgacttctggggccagggaaccctggtcaccgtctcgtcag

SEQ ID NO: 2727 - DNA, 376 bp, Artificial Sequence
  Synthetic construct
caggtgcagctggtgcaatctggggctgaggtgaagaagcctggggcctcagtgaaggtctcctgtaaggcttctggatacaacttcaatgaccacttcatccactgggtgcgacaggcccctggactagggcttgagtggctgggatggatcaaccctaacgatggagacacaaagtattcgcagacctttcagggcagggtcaccatgaccagggacacgtccatcagcacagcctacatggagctgagcaggctgagatctgacgatacggccttctattactgtgcgagagatgaaacggatgtgatggggttcagaatggggtactactttgactcttggggccagggaaccctggtcaccgtctcctcat

SEQ ID NO: 2728 - DNA, 367 bp, Artificial Sequence
  Synthetic construct
caggtccttctggtacaatctggggctgaggtgaagaagcctggggcctcagtgaaggtctcctgcaaggtttccgggtacaccctcactgacttagccatccactgggtgcgacaggctcctggaaaagggcttgagtggatgggaggtttggatcctgacgacggtgaaacactctacgcacagatgttccagggcagagtcaccatgaccgaggactcaactggtgccacagccgacctggagctgagcagcctgacatctgaggacacggccgtctattactgtgcaatcgcaggatcagatagtagctctggattttactttgactactggggccagggtaccctggtcaccgtctcctcag

SEQ ID NO: 2729 - DNA, 364 bp, Artificial Sequence
  Synthetic construct
caggtccaattggtacagcctggggctgaggtgaagaagcctggggcctcagtgaaggtctcctgcaaagtttccggaaaaaccctcactgaattactcatccactgggtgcgacaggctcctggaaaagggcttgagtggatggggggttttgatccagaagatggtgaaacaatctccgcacagaaattccaggccagagtcaccatgaccgcggacggatcttcagacacagcctacatggaactgagtagcctaagatctgaggacacggccgtctattactgtgcaacccagacatatacttcggagagctcccggggtgacttctggggccagggaaccctggtcaccgtctcctcag

SEQ ID NO: 2730 - DNA, 355 bp, Artificial Sequence
  Synthetic construct
caggtgcagctggtgcagtctggggctgaggtgaagaagcctggggcctcagtgaaggtctcctgtacggcctctggacacatcgtcagcagctatgagatccactgggtgcgacaggtcactggacaagggcttgagtggctgggatgcatgaacccaaccagtggtgacacatactttccgcagaagttccagggcagagtctccattaacagggacacctccataaccaccgcctatatggaactgaagagcctgacatctgaagacacggccgtctactactgtgcgggaggccgcgggggatatcacgctgactcctggggccagggaaccctggtcaccgtctcctcag

SEQ ID NO: 2731 - DNA, 373 bp, Artificial Sequence
  Synthetic construct
caggtgcacctggtgcagtctggggctgagttgaagaagcctggggcctcgctgaggatttcctgcaaggcaagtggatacaccttcaccgattactatatccactgggtgcggcaggcccctggacaggggcttgagtggatgggaataatcaaccctactagtgatagcacagacttcccaccgaaatttaagggccgagtctccatgaatagggacacgtccacgaatacagcccacttggacctgaacagcctgagatctgaggacacggccatctattattgtgcgcgaggacagactgtcggacgatactttaactggttaccccttcaacactggggccagggcaccctggtcaccgtctcgtcag

SEQ ID NO: 2732 - DNA, 370 bp, Artificial Sequence
  Synthetic construct
cagtcccttctgacgcagtctggggccgagttgaagaagcctgggtcctctgtgagggtctcctgtcaggcttctggagaccccgtcaacaactatgccatccattgggtgcgacgggcccctggacaaggtcttgagtggatggggtgggtcagccctatttctggaagaggtgaatatgcaccgaagtttcagggcagactcaacattctcgcggaacagtctacgcgaacagtctacatggaactgagtggcctgtcacgtgacgacacggccatttattactgtgcgcgacacaggggacgtgggaattctgccggagtggggttcgacccctggggccaggggacccaggtcaccgtctcctctg

SEQ ID NO: 2733 - DNA, 376 bp, Artificial Sequence
  Synthetic construct
caggtccaacttgtgcagtctgcggctgacgtgaagaagcctggggcctcagtgaaggtttcctgcaaggcttctggatacaccttcacttcctatgctatccattgggtgcgccaggcccccggagaaaggcttgagtggatgggatacatcaacgctgccagtggtgacaccaaatactcacagatgttccagggcagagtcaccattaccaccgatacatccgcgagcacagcctacatggagctgagcagcctgagatatgaagacacggctgtgtattattgtgcgagagatctttcggaagtggtgggagctgctgtttccgatgcttttaatgtctggggccaagggactatggtcaccgtctcttcag

SEQ ID NO: 2734 - DNA, 361 bp, Artificial Sequence
  Synthetic construct
gaggtgcagctggtgcagtctggagcagaggtgaaaaagccgggggagtctctgaagatctcctgtaagggttctggatacagctttaccagctactggatcgcctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagagcagatggctaccgaaagaaaatccttgactactggggccagggatccctggtcaccgtctcctcag

SEQ ID NO: 2735 - DNA, 367 bp, Artificial Sequence
  Synthetic construct
gaggtgcagctggtgcagtctggagcagaggtgaaaaagccgggggagtctctgaagatctcctgtcagggttctggatacagctttaccaactactggatcgcctgggtgcgccagatgcccgggaaaggcctggagtggatggggatcatctatcctaatgattttgataccagatacagcccgtccttccgaggccaggtcaccatctcagccgacaagtccaacaacaccgcccacctgcagtggagcagcctgaaggcctcggacaccgccatttattattgtgcgagacaatcaggaagtagtggttatatctcctattttaaatactggggccagggaaccctggtcaccgtctcctcag

SEQ ID NO: 2736 - DNA, 367 bp, Artificial Sequence
  Synthetic construct
gaggtgcagctggtgcagtctggagcagaggtgaaaaagcccggacagtctctgacaatctcctgtaaggcttctggatattactttagtcaatactggatcgcctgggtgcgccagatgcccgggaaaggcctggagtggatgggggtcatctatcctggtgactctgacaccagatacagcccgtccttccaaggcctggtcaccatctcagccgacaagtccaccacgaccgcctacctgcagtggggcagcctgaaggcctcggacaccgccatgtattattgtgcgagaggtataagtggaattacctacccgtatcactttgactactggggccagggaaccctggtctccgtctcctcag

SEQ ID NO: 2737 - DNA, 385 bp, Artificial Sequence
  Synthetic construct
gaggtgcagctggtgcagtctggagcagaggtgagaaagccgggggagtttctggagatctcctgtaaggattctggcgacaggttaagcagtcactggatcgcctgggtgcgccaggtgtccgggaaaggcctggagtggatgggggtcatcaatcctgaagactctgatattagatatggcccgtccttccaaggccaggtcagcatttcagccgacaagtccaagagcaccgcctacttgcagtggggcagcctgaaggcctcggacagcgccatgtattactgtgcgacattacgtatgatggattattatgatagtagtggtcattatccggactactttgactactggggccagggaaccctggtcaccgtctcctcag

SEQ ID NO: 2738 - DNA, 370 bp, Artificial Sequence
  Synthetic construct
gaggtgcgactggtgcagtctggagcagaggtgaaaaagccgggggaatctctgaagatctcctgtaagggctctggatataattttagtagctactggatcggctgggtacgccagatgcccgggaaaggcccggagtggatggggatcatctttcctgaggactctgataccagatacagcccgtccttccaaggccaggtcctcatctcagccgacaagtccagcagcaccgcctacctacagtggagcagcctgaaggcctcggacaccgccatgttttactgtgcgagacgcaacccttatggctccggccggggttataactttgactcctggggccagggaaccctggtcaccgtctcctcaa

SEQ ID NO: 2739 - DNA, 357 bp, Artificial Sequence
  Synthetic construct
gaggtgcagctggtgcagtctggagcagaggtgaaaaagccgggggagtctctgaagatctcctgtaagggttctggatacagctttaccaaccactggatcggctgggtgcgccaagtgcccgggaaaggcctggagtggatggcgatcatctatcctggtgactctgataccagatacagcccgtccttccaaggccaggtcaccatctcagccgacaagtccatcaataccgcctacctgcaatggagtagcctgaaggcctcggacagcgccatttattactgtgcgagaactacccagtatttcttctacatggacgtctggggcaaagggaccacggtcaccgtctcctca

SEQ ID NO: 2740 - DNA, 397 bp, Artificial Sequence
  Synthetic construct
gaggtgcagctggtgcagtctggagcagaggtgaaaaagccgggggagtctctgaagatctcctgtaagggttctggatacagcttttccagttactggatcggctgggtgcgccagaagcccgggaaaggcctggagtggatggggatcataaatcctgctgactcgggtgtcagatacagtccgtccttgcaaggccaggtcatcatctcagtcgacacctcaataaataccgcctacctacattgggacagcctgaaggcctcggacaccgccatatattactgtgcgcgacccgatagtggtgacgaactcatcaatccgggccggccaagtggttattacacgggggctattgatctgtggggccacgggacagtggtcaccgtctcctcag

SEQ ID NO: 2741 - DNA, 364 bp, Artificial Sequence
  Synthetic construct
gaggcgcagctggtgcagtctggagcagaggtgaaaaagccgggggagtctctgaggatctcctgtaaggcttctggatacctctttggcagctattggatcggctgggtgcgccagaagcccggggagaccctggagttgatgggggtcatctatcctggtgactctgatacaagatacagcccgtccttcgaaggccaggtcaccgtctcagtcgacaagtccatcagcaccgcctacctgcagtggagcagcctgaaggcctcggacagcgccatgtatttctgtgcgagatcagtgaccagtggctggtatggtactctcgactattggggccagggcaccctggtcaccgtctcctcag

SEQ ID NO: 2742 - DNA, 367 bp, Artificial Sequence
  Synthetic construct
gaggtgcagctggtgcagtctggagcagaggtgaaaaagccgggggagtctctgaagatctcctgtaaggcttctggatacaggtttaccagttactggatcggctgggtgcgccagatgcccggaaaaggcctggagtggatgggtatcatgtttcctgatgactctgataccagatacagtccgtccttccaaggccaggtcaccatgtcagccgacaggtccgtcaacaccgcctacctgcagtggagcagcctgaaggcctcggacaccgccatgtattactgtgggagaccgcgtaatagtgggagttattatgatgcttttgatatatggggccaagggacactggtcaccgtctcttcga

SEQ ID NO: 2743 - DNA, 367 bp, Artificial Sequence
  Synthetic construct
gaggtgcagctggtgcagtctggagcagaggtgaaaaagccgggggagtctctgaagatctcctgtcaggtttctggatacagctttaccagctactggatcggctgggtgcgccagatgcccgggaaaggcctggagtggataggaaatatctatcctggtgactctgataccagatacagcccgtccttccaaggccaggtcaccatctcagtcgacacgtccatcaacaccgcctacctgcactggagcagcctgaaggcctcggacaccgccatgtattactgtgcgagacattccttgtctaactttaaacaggcctggttcgacccctggggccagggaacccaggtcatcgtctcctcag

SEQ ID NO: 2744 - DNA, 373 bp, Artificial Sequence
  Synthetic construct
ggggtgcacctggagcagtctggagcagaggtgaaaaagccgggggagtctctgaagatctcctgtaagggttctggatacagctttcccaattactggatcggctgggtgcgccagatgcccgggaaaggcctggagtggatggcaatgatctatcctgatgactctgataccagatacaacccgtccttccaaggccaggtcaccatctcagccgacaagtccatcagcaccgcctacctgcagtggaacaacctgaaggcctcggacaccgccatgtattgctgtgcgagaaatccgggagatgatagtactggtcacccctcttactttaactactggggccagggaaccctggtcaccgtctcctcag

SEQ ID NO: 2745 - DNA, 367 bp, Artificial Sequence
  Synthetic construct
gaagttcaactggaacagtctggagcggaggtgaagaagccgggggagtctctgaagatcgcctgcaagtgttctggatacatttttaccgattactggatcggctgggtgcgccagatgcccgggaaaggcctggagtggatggccatcatttatcctggtgactctcatgtcagatggagtccgtccttccaaggccaggtcaccctctcagtcgacaagtccgtcaacaccgcctacctgcagtggaacaacttgagggcctcggacaccgccatgtatttttgtgcgagacaagagaggcgtatcggcagtggcaaccccttagagttctggggccagggaacccaggtcatcgtctcctcag

SEQ ID NO: 2746 - DNA, 367 bp, Artificial Sequence
  Synthetic construct
gaggtgcagctggtgcagtctggagcagaggtgaaaaagtcgggggagtctctgaagatctcctgtaagggttctggatacagctttagcacatactggatcggctgggtgcgccagatgcccgggaaaggcctggagtggatgggaatcctctatcctggtgactcagatattagatatagtccgtccttcgaaggccaggtcaccatctcagccgacaagtccatcagcaccgcctacctgcagtggagcagcctgaaggcctcggacaccgccatctattactgtgtgagtcccggcgattgtagtggtggtacttgctacccggcctactggggccagggaaccctggtcaccgtctcctcag

SEQ ID NO: 2747 - DNA, 358 bp, Artificial Sequence
  Synthetic construct
gaggtgcagctggtgcagtctggagcagaggtcaaaaagccgggggagtctctgaagatctcctgtaagggttctggatacagctttaccagctactggatcggctgggtgcgccagatgcccgggaaaggcctggagtggatggggaccatctatcctggtgactctgataccatatacagcccgtccttccagggccaggtcaccatctcagccgacaagtccatcagcaccgcctacctgcagtggagcagtctgaaggcctcggacaccgccatgtattattgtgcgagacgatttccgaatagtgaacattttgtctactggggccagggaaccctggtcactgtctcttccg

SEQ ID NO: 2748 - DNA, 300 bp, Artificial Sequence
  Synthetic construct
gggggatacagctttagtagatattggatcggctgggtgcgccagatgcccgggaaaggcctggagtggatggggatcatcaatcctggtgactctgaaactagatacagcccgtccttccaaggtcaggtcaccatctcagccgacaagtccatcagcaccgcctacctgcagtggagtagcctgaaggcctcggacaccgccatttattactgtgcgagacatgtggcaactcgtccctactacttctactactacatggacgtctggggcaaagggaccacggtcaccgtctcctca

SEQ ID NO: 2749 - DNA, 373 bp, Artificial Sequence
  Synthetic construct
gaggagcagctggtgcagtctggagcagaggcgagaaagccgggggagtctctgaagatctcctgtaagggttctggatacagttttaccaattattggatcggctgggtgcgccagatgcccgggaaaggcctggagtggatggggatcatctatcctgatgacgctgatacaacatacagcccggccttccaaggccaggtcaccatctcagccgacaagtccatcagaaccgcctatttgcagtggagcagcctgaaggcctcggacaccgccatgtattactgtgcgcgacgtaatggttaccatgatagtagtgcttatggcggttttgatatctggggccaagggacaatggtcaccgtctcttcag

SEQ ID NO: 2750 - DNA, 370 bp, Artificial Sequence
  Synthetic construct
gaggtgcacctggtgcagtctggagcagaggtgaaaaagccgggggagtctctaaagatctcctgtcagggttctggatacagctttaccaactactggatcggctgggtgcgccagatgcccgggaaaggcctggagtggatggggatcatctatcctggtgattctgataccagatacagcccgtccttccaaggccaggtcaccatctcagccgacaagtccatcagcaccgcctacctgcagtggggcagcctgaaggcctcggacaccgccatgtattactgtgcgagaggggaagatgcctacaatactgagcctgatgcttttgatatctggggccaagggacaagggtcaccgtctcttcag

SEQ ID NO: 2751 - DNA, 358 bp, Artificial Sequence
  Synthetic construct
gaggtgcagctggtgcagtctgaagcagaggtgaaaaagccgggggagtctctgaagatctcctgtaaggcttctggatacacctttaccagcctctggatcggctgggtgcgccagatgcccgggaaaggcctggagtggatggggatcatctatcctggtgactctgataccatatatagcccgtccttccaaggccgggtcactctctcagtcgacaagtccatcagcaccgcctacctacagtggagcagcctggaggcctcggacaccgccatatattactgtgcgaaacatgaagcgcgtgattattactttgactcctggggccagggaaccctggtcaccgtctcctcag

SEQ ID NO: 2752 - DNA, 348 bp, Artificial Sequence
  Synthetic construct
gaggtgcagctggtgcagtctggaccagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccaaatatagcccgtccttccaaggccaggtcaacatctcagccgacaagtccatcagcaccgcctacctgcagtggagcagcctgaaggcctcggacaccgccatgtattactgtgcgagacggaggagcttcgtggacgtctggggcaaagggacaacggtcaccgtctcctca

SEQ ID NO: 2753 - DNA, 387 bp, Artificial Sequence
  Synthetic construct
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaagtagagttgtagtagtaccagctgctatgaccccctactactactactacatggacgtctggggcaaagggaccacggtcaccgtctcctca

SEQ ID NO: 2754 - DNA, 376 bp, Artificial Sequence
  Synthetic construct
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacataagggaaggggacgtatagcagtggctggtaaagcttttgatatctggggccaagggacaatggtcaccgtctcttcag

SEQ ID NO: 2755 - DNA, 357 bp, Artificial Sequence
  Synthetic construct
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatcggccccactatggcctcatggacgtctggggcaaagggaccacggtcaccgtctcctca

SEQ ID NO: 2756 - DNA, 358 bp, Artificial Sequence
  Synthetic construct
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtcaggctggagagggcccctttgactactggggccagggaaccctggtcaccgtctcctcag

SEQ ID NO: 2757 - DNA, 369 bp, Artificial Sequence
  Synthetic construct
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactggattgtagtggtggtagctgctacccgcccatggacgtctggggcaaagggaccacggtcaccgtctcctca

SEQ ID NO: 2758 - DNA, 375 bp, Artificial Sequence
  Synthetic construct
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagatccgttcggggagtgggagattactactactactactacatggacgtctggggcaaagggaccacggtcaccgtctcctca

SEQ ID NO: 2759 - DNA, 370 bp, Artificial Sequence
  Synthetic construct
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagcgtcggctactatggttcggggagttctgatgcttttgatatctggggccaagggacaatggtcaccgtctcttcag

SEQ ID NO: 2760 - DNA, 372 bp, Artificial Sequence
  Synthetic construct
gaggtgcagctggtgcagtctggagcagaggtgaaaaagccgggggagtctctgaagatctcctgtaaggtctctggatacagctttagtagatattggatcggctgggtgcgccagatgcccgggaaaggcctggagtggatggggatcatcaatcctggtgactctgaaactagatacagcccgtccttccaaggtcaggtcaccatctcagccgacaagtccatcagcaccgcctacctgcagtggagtagcctgaaggcctcggacaccgccatttattactgtgcgagacatgtggcaactcgtccctactacttctactactacatggacgtctggggcaaagggaccacggtcaccgtctcctca

SEQ ID NO: 2761 - DNA, 391 bp, Artificial Sequence
  Synthetic construct
gaggtgcagttggtgcagtctggggctgaggtgaaaaggccgggggagtctctgaagatctcctgtcagggttctggatatgactttaccgaccactggatcggctgggtgcgccagatgcccgggaaaggcctggagtggatggggatcatctatcctggtgactctgatagtagatacagtccgtccttccaaggccaggtcaccatctcagtcgacaagtccaccagcaccgcctacctgcagtggagcagcctgaaggcctcggacagcgccatgtattactgtgcgagacgagggaaggatgataacagtgcttactacttggggaggacccgaggccgggtatttgactattggggccagggaaccctggtcaccgtctccccag

SEQ ID NO: 2762 - DNA, 355 bp, Artificial Sequence
  Synthetic construct
gaggtgcagctggcgcagtctggggcagaggtgaaaaagccgggggaatctctgaagatctcctgtcaggcttctggatacagttttaccaagtactggatcggctgggtgcgccagatgcccggggaaggcctggagtggatggggatcatctatcctgatgactctgataccagatacagcccgaccttccacggccaggtctccatctcagccgacaggtccatcaataccgtctacttgcagtggagcagtctgaaggcctcggacaccgccatgtattactgtgcgagacagggcggcagctaccgcattgactactggggccagggaaccctggtcaccgtctcctcag

SEQ ID NO: 2763 - DNA, 373 bp, Artificial Sequence
  Synthetic construct
gaggtgcagctggtgcagtctggagcagaggtgaaaaagccgggggagtctctgaagatctcctgtaagggttctggatacagctttaccacctactggatcggttgggtgcgccagatgcccgggaaacgcctggagtggatgggagtcatctatcctggtgactctgacaccagatacagcccgtccttccaaggccaggtcaccatctcagccgacaagtccatcagcaccgcctacctgcagtggaccagcctgaaggcctcggacaccgccatgtattactgtgcgagagtgggggactacggtgactacggtagctactggtacttcgatctctggggccgtggcaccctgatcactgtctcctcag

SEQ ID NO: 2764 - DNA, 361 bp, Artificial Sequence
  Synthetic construct
gaggtgcagctggtgcagtctggagcagaggtgaaaaagccgggggagtctctgaacatttcctgtaagggttctggatacagttttaccagttactggatcgtctgggtgcgccagatgcccggaaaagggctggagtggatgggagtcatctaccctggtgactctgataccagatacagcccgtccttccaaggcgaggtcgccatctcagccgacaactccatcagcaccgcctacctgcaatggagcagcctgaaggcctcggacaccgccatgtactactgtgcccagagtgtaactggagctacagatgcttttgatatttggggccaagggacgatggtcaccgtctcttcag

SEQ ID NO: 2765 - DNA, 364 bp, Artificial Sequence
  Synthetic construct
gaggtgcagctggtgcagtctggagcagaggtgaaaaagccgggggagtctctgaagatctcctgtaagggttctggatatagctttcccaactactggatcgtctgggtgcgccagatgcccgggaaaggcctggagtggatggggatcatctttcctggtgactctgatagcagagtcagcccgtccttccaaggccaggtcaccatctcagccgacaagtccatcagaaccgcctacctgcagtggagcagcctgaaggcctcggacaccgccatgttttactgtgcgagattggggggtcctacggtgactccccgttttgactactggggccagggaaccctggtcaccgtctcctcac

SEQ ID NO: 2766 - DNA, 367 bp, Artificial Sequence
  Synthetic construct
gaggtgcagctggtgcagtctggagcagaagtgaaaaagccgggggagtctctgaagatctcctgcaagggttctggatacgactttagcagccactggatcgtctgggtgcgccagatgtccgggaaaggcctggagtggatgggagtcatctatcctggtgactctgataccagatataacccgtccttccacggccaaggcaccatctcagccgacaggtccagcagcgtcgcctacttggagtggagcagcctgagggcctcggacaccgccatgtacttctgtgcgagactggcgatgaaggaatggagtgtcggtgcttttgatctttggggccaagggacaatggtcaccgtctcttcag

SEQ ID NO: 2767 - DNA, 361 bp, Artificial Sequence
  Synthetic construct
caggtccaacttgtgcagtctggggctgaggtgaagaagcctggggcctcagtaaagatatcctgcaaggcttctggatacagtctcagtgattttggcatctactgggtgcgccgggcccccggacaaaggcttgagtggatgggatggatcaacacctaccaaggcaatacaaaaatttcacagaaattccagggcagagtcaccatcaccagggacaaatccgcgaacacagcccacctggaggtgagaagactgagtcacgaagacacggctctatattactgtgcgagagacatgtggggccaccactacgcgttcgacccctggggccagggaacccaggtcaccgtctcctcag

SEQ ID NO: 2768 - DNA, 370 bp, Artificial Sequence
  Synthetic construct
caggtccagctgctgcagtctggggctgaggtgaagaagcctgggtcctcggtgaaggtgtcctgcaagacctctggaggcaccttcagcaagtatgatatctcgtgggtgcgacaggccccgacacagggtcttgagtggatgggagggatcatccctgtgtttgggacaccaaactacgctgagaagtttaagggcagagtcacaattacgacggacgaatccacgacgacaacctacatggaactaaacagtttgacatctgaagacacggccgtctatttctgtgcccgccggtcgcagcagctcctggtccccggatgggcttttgatatctggggccaagggacaagggtcatcgtctcttcag

SEQ ID NO: 2769 - DNA, 364 bp, Artificial Sequence
  Synthetic construct
gaggtgcagctggtggagtccgggggaggcttggtacagcctggggggtccctgagactctcctgtgcagcctctggattcaccatcggtaattttgaaatgaactgggtccgccaagctccagggaagggcctggagtggatttcatacatcagtaatagtggtgatactatatactacgcagactctgttatgggccgattcaccatctccagagacaacgccaagaattcagtgtttctgcaaatgaacagcctgagagccgcggacacggctgtatattattgtgcgagacttggggattacagtgtctccgatatggggaactactggggccagggaaccccggtcaccgtctcctcag

SEQ ID NO: 2770 - DNA, 364 bp, Artificial Sequence
  Synthetic construct
gaggtgcagttgttggagtctgggggagacttggtacagcctggggggtccctgagactctcctgtgcagcctctggactcacctttagcacctttgccatgaactgggtccgccagactccagggaaggggctggagtgggtctcaggtgttaatgttggtggtggaatcacatactacgcagcctccgtgaagggccggttcaccatttccagagacaattccaagaacaggctatatctacaaatgaacagccttagagccgaggacacggccgtatattactgtacgtttcggggggcctcttgggggagtcttcgttatagctattggggccagggacttctggtcaccgtctcctcag

SEQ ID NO: 2771 - DNA, 382 bp, Artificial Sequence
  Synthetic construct
gaggtgcagctggtggagtctgggggagacatggtacatcctggagggtccgtgagactctcctgtgtaggttctggactcaccttcagcagttctgaaatgaactgggtccgccagactccagggatgggactggagtgggtttcatatattagtggtagtggtagtaccaaatattatgcagactctgtgaggggccgattcaccatctccagagacaacgccaagaattccctggctctgcagatgaacagcctgagagtcgaggacacgggtgtttatttttgtgcgaaagatgtggggtattgtagtagtggcagctgcttccgccccctggcttttcaaatctggggccaagggacaaaggtcaccgtctcttcag

SEQ ID NO: 2772 - DNA, 373 bp, Artificial Sequence
  Synthetic construct
gaggtgcagctggtggagtctgggggaggcttggtaaagcctggggggtcccttaaaatctcctgtgcagcctctggattcactttcagtaacgcctggatgaactgggtccgccaggcgccagggaaggggctggagtgggttggccgtgtgaaaagcaaaactgatggtgggacaacagactacgctgcacccgtgaaaggcagattcaccatctcaagagatgattcagaaaacacgttgtttctgcaaatgaacagcctgaaaaccgacgacacagccgtgtattactgtgccacagatcaatgggggtacggtgacttcgggaactttgactactggggccagggaaccctggtcaccgtctcctcag

SEQ ID NO: 2773 - DNA, 367 bp, Artificial Sequence
  Synthetic construct
gaggcgaacctggtggcgtcggggggagggttggtacagcctggagggtccctgagactctcctgtgcagcctctggattcagctttaaggactatgaaatgaactgggtccgccaggctccagggaagggactggagtgggtctcatacattaataacattggtgacaacatacattatggagactctgtgaagggccgattcaccatctccagagacaacgccaagaactctctctatctgcacatgaacaacctgagagccgaggacacggctgtttatttctgtacgcgggttttgtggttcgagggacgatatgatacttttgatgtttggggccaagggacaatggtcaacgtctcttcag

SEQ ID NO: 2774 - DNA, 381 bp, Artificial Sequence
  Synthetic construct
gaggtgcagctggtggagtctgggggaggcctggtcaagccgggggggtccctgagactctcctgttcagcctctggaatcaccttcagtagttatggcatgaactgggtccgccaggctccagggaagggactggagtgggtctcatccattagtagtagtagtaatttcataaactacgcagactcagtgaagggccgattcaccgtctccagagacaacgccaagaactcactgtatctgcagatgaacagcctgagagccgaggacacggctgtgtattactgtgcgtcccgctattgtcgtgctggcagctgctatcaccattactattactatatggacatctggggcaaagggaccacggtcaccgtctcctca

SEQ ID NO: 2775 - DNA, 364 bp, Artificial Sequence
  Synthetic construct
gaggtgcagctggtggagtctgggggaggcttggtacagcctggggggtccctgagactctcctgtgcagcctctggattcacctttagcgactatgccatgaactgggtccgccaggctccagggaaggggctagagtgggtctcaggtattactagtggtggttacacatactacgcagactccgtgaagggccggttcaccatctccagagacaattccaagaacacgctgtatctgcaagtgaacagcctgagagccgaggacacggccgtatattactgtgcgaaagggggcggttgtagtggtgattgctattttcccctcgactggggccagggaaccctggtcaccgtctcctcag

SEQ ID NO: 2776 - DNA, 370 bp, Artificial Sequence
  Synthetic construct
gaggtgcagctggtggactctgggggaggcttggtacagcctggagggtccctgagactcacctgtgcagcctctggattcaccttcagtagttatgaaatgaactgggtccgccaggctccagggaaggggctggagtggatttcatacattagtagaagtggtagtaccatatactacgcagactctatgaagggccgattcaccatctccagagacaacgccaagaactcactgtatctgcaaatgaagaccctgagagccgaggacacggctgtctattactgtgcgagaggcctggggtattacgatattttgactggtgcttttgactactggggccagggaaccctggtcaccgtctcctcag

SEQ ID NO: 2777 - DNA, 376 bp, Artificial Sequence
  Synthetic construct
gaggtgcagttgttggagtctgggggaggcttggtacagcctggggggtccctgagactctcctgtgcagcctctggattcacctttagcaactatgccatgaactgggtccgccaggctccagggaaggggctggagtgggtctcaattattagtagtgatgctgataacacatactacgcagactccgtgaggggccggttcaccatctccagagacaattccaagaacacgctgtatctggacatgaagagcctgagagacgaggacacggccatatattactgtgcgaaagatagatcagcctccatatatggtgcggggactcccgcccttgactactggggccagggaaccctggtcaccgtctcctcag

SEQ ID NO: 2778 - DNA, 354 bp, Artificial Sequence
  Synthetic construct
gaagtgcagctgttggagtctgggggaggcttggtacagcccggggggtccctgagactctcctgtgcagcctctggattcacctttagcaactatgccatgaactgggtccgccaggctccagggaaggggctggagtgggtctcaggtattagtggtggtggaattacttactacgcagactccgtggagggccggttcaccatctccagagacaattccaagaaaatcctgtatctgcaaattaacagcctgagagtcgaggacacggccgtatattactgtgcgaaagatcgtgacttctactacttcatagacgtctggggcggagggaccacggtcaccgtctcttca

SEQ ID NO: 2779 - DNA, 367 bp, Artificial Sequence
  Synthetic construct
gaggtacagctgttggagtctgggggaggcttggtacagcctggggggtccctgagactctcctgtgcagcctctggattcacttttagcaattatgccatgaactgggtccgccaggctccagggaaggggctggagtgggtctcaggtatgattggtactggtggtaccacatactacgcagactccgcgaagggccggttcaccatctccagagacaattccaagaatacgctgtatctgcaaatgaacagcctgagagccgaggacacggccgtatattactgtgcgaaggcgcgcgtaccagctgctatcagattctactttgactcctggggcctgggaaccctggtcaccgtctcctcag

SEQ ID NO: 2780 - DNA, 355 bp, Artificial Sequence
  Synthetic construct
gaggtgcagctggtggagtctgggggaggcttggtacagcctggagggttcctgagactctcctgtgcagcctctgtattcaatttcagaagttatgaaatgaactgggtccgccaggctccagggaaggggctggagtgggtctcatatattagtagcagtggtagtattgtatcctacgcagactccgtgaagggccgattcaccatctccagagacaacgccaagaactcactttatctggacatgaacagcgtgagagtcgaggacacggctgtttattactgtgcgagagtcactaggttgaactggttcgacccctggggccagggaaccctggtcaccgtctcctcag

SEQ ID NO: 2781 - DNA, 363 bp, Artificial Sequence
  Synthetic construct
gcggtgcagttggtggagtctgggggaagcctggtcaagcctggggggtccctgagactctcctgtgcagcctctggattcaccttcagtacctataacatgaactgggtccgccaggctccagggaaggggctggagtgggtctcatcaatcagtactagtggttcttacttagactacgcagcctcagtgaagggccgcttcaccatctccagagacaacgccaagaacttactgtatcttcaaatgaacagcctgagggacgaggacgcggctgtgtattactgtgcgcgaaatgaaggatacagctattctaactacatggacgtctggggcagagggaccacggtcaccgtctcccca

SEQ ID NO: 2782 - DNA, 382 bp, Artificial Sequence
  Synthetic construct
gaggtgcaactggtggagtctgggggaggcctggtcaagcctggggggtccctgagactctcctgtgcagcctctggattcaccttcagtgactataacatgaactgggtccgccaggctccagggaaggggctggagtgggtctcatccattagtagtagtggtagtcacatttactacgcagactcactgaagggccgactgaccatctccagagacaacgccaagaaaacactgtttctgcaaatgaacagcctgagagccgaagacacggctgtgtattactgtgcgagatccccccccccctattactacgccagtagtggttattacttcgcctttgactactggggccggggaaccgtggtcaccgtctcctcag

SEQ ID NO: 2783 - DNA, 373 bp, Artificial Sequence
  Synthetic construct
gaggtgcaactggtggagtctgggggaggcctggtcaagcctggggggtccctgagactctcctgtgcagtctctggattcaacttcagtagctatagcatgaactgggtccgccaggctccagggaaggggctggagtgggtctcatccattagtagtaccagtcgttacataaactacgcagactcagtgaagggccgagtctccatctccagagacaacgccaagaactcactgtatctgcaaatgaacagcctgacagccgaggacacggctctgtattactgtgcgagagagaagaacttgtatagtggctacgatccgacgggcttaggctactggggccagggaaccctggtcaccgtctcctcag

SEQ ID NO: 2784 - DNA, 361 bp, Artificial Sequence
  Synthetic construct
gaggtgcagctggtggagtctgggggaggcccggtcaagcctggggggtccctgagactctcctgtgcagcctctggattcgccttcagtagctttagcatgaactgggtccgccaggctccagggaaggggctggagtgggtctcatccattagtagtggtagtaattacatagactacgcagagtcagtgaagggccgattcaccatttccagagacaacgccaagaactcactgtatctgcaaatgaatagcctgacagccgaggactcggctgtatatttctgtgcgacctctggttcgggggcttattataaccctgactactggggccagggaaccctcgtcaccgtctcctcag

SEQ ID NO: 2785 - DNA, 379 bp, Artificial Sequence
  Synthetic construct
gaggtgcagctggtggagtctgggggaggcctggtcaagccgggggggtccctgagactctcctgtgcaggctctggattcagcttcagtaactataccatgaactgggtccgccaggctccagggaaggggctggagtgggtctcatccattagtggtagtagtaatgacatatactacgcagactctgtgaagggccgttttaccatctccagagacaacgccaagaactcactgcatctgcaaatgaacagcctgagagccgaggacacgggtatatattactgtgcgacagattccacattttacgatgttttgactactatctgggggtactttgactactggggccagggaaccctggtcaccgtctcctcag

SEQ ID NO: 2786 - DNA, 355 bp, Artificial Sequence
  Synthetic construct
gaggtgcagctggtggagtctgggggaggcctggtcaagcctggggggtccctgagactctcctgtacagcctctggattcaacttcattagtcataccatgaactgggtccgccaggctccagggaaggggctggagtgggtctcatccattaggagtagtagtacttacatatattacgcagactcactgaagggccgaatcaccatctccagagacaacgccaagaactcactgtatctgcaaatgaacagcctgagagtcgaggacacgggtgtctattactgtgcgacagatagtgcctacgagtactttgactcttggggccagggaaccctggtcaccgtctcctcag

SEQ ID NO: 2787 - DNA, 364 bp, Artificial Sequence
  Synthetic construct
gaggtgcagctggtggagtctgggggaggcctggtcaagcctggggggtccctgagactctcctgtgcagcctctggattcatcctcagtagatttagcatgaactgggtccgccaggctccagggaaggggctggagtgggtctcatccataagtggtagtagtagttacagatattacgcagactcagtgaagggccgattcaccgtctccagagacaacgccaagaactctctgtatctgcaaatgaacagcctgcgagccgaggacacggctgtgtattactgcgcgagaagggaggcggcgatgagtaatggtaaccttgactactggggccagggaaccctggtcaccgtctcctcag

SEQ ID NO: 2788 - DNA, 376 bp, Artificial Sequence
  Synthetic construct
gaggtgcagctggtggagtctgggggaggcctggtcaagcctggggggtccctgagactctcctgtgcagcctctggattcaccttcagttactatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagacccgaggacacggctgtgtattactgtgcgagagaaccatattgtggtggtgattgcccgccgggatattggttcgacccctggggccagggaaccctggtcaccgtctcctcag

SEQ ID NO: 2789 - DNA, 376 bp, Artificial Sequence
  Synthetic construct
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaaggggttaggagcggatacagctatgcctttgatgcttttgatatctggggccaagggacaatggtcaccgtctcttcag

SEQ ID NO: 2790 - DNA, 361 bp, Artificial Sequence
  Synthetic construct
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaatactatggttcggggagttattatacttggtggggccagggaaccctggtcaccgtctcctcag

SEQ ID NO: 2791 - DNA, 370 bp, Artificial Sequence
  Synthetic construct
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatccgaggaggaatcactatgatagtagtggctctgactactggggccagggaaccctggtcaccgtctcctcag

SEQ ID NO: 2792 - DNA, 358 bp, Artificial Sequence
  Synthetic construct
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagattttttgggagctagctactttgactactggggccagggaaccctggtcaccgtctcctcag

SEQ ID NO: 2793 - DNA, 379 bp, Artificial Sequence
  Synthetic construct
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagatccgcccagctctatgatagtagtggttattcggggggcctctttgactactggggccagggaaccctggtcaccgtctcctcag

SEQ ID NO: 2794 - DNA, 369 bp, Artificial Sequence
  Synthetic construct
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgcctttttcgctctacggggggaactactactactacatggacgtctggggcaaagggaccacggtcaccgtctcctca

SEQ ID NO: 2795 - DNA, 358 bp, Artificial Sequence
  Synthetic construct
gaggtccaactggtgcagtcggggggaggcctggtcaagccgggggggtccctgagactctcctgtgcagcctcaggtttcaccttcagcatgtacagtatgaactgggtccgccaggctccagggaaggggctggagtgggtctcattcattagtactagtagtagttacacatattacgcagactcagtgcagggccgattcaccatctccagagacaactccaagaattcactgtatctgcaaatgaacaacctgacagccgaggacacggctgtctattactgtgcgacttcggatcggggaacgactacggtgactccttggggccagggcaccctggtcgtcgtctcctcag

SEQ ID NO: 2796 - DNA, 399 bp, Artificial Sequence
  Synthetic construct
gaattgcagctggtggagtctgggggaggcttggtacagcctggagggtccctgagactctcctgtgcggcctctggattcaccttcagtagttatgaaatgaactgggtccgccaggctccagggaaggggctggagtgggtttcatacattagcattattggtagtaccatatactacgcagactctgtgaagggccgattcaccatctccagagacaacgccaagagctcactgtatctgcaaatgaataacctgagagccgaggacacggctgtttattactgtgcgagattttcggccggaaggcctcaatattgtagtggtggtacctgctaccctccggacttctattacatggacgtctggggcaaagggatcacggtcaccgtctcctca

SEQ ID NO: 2797 - DNA, 373 bp, Artificial Sequence
  Synthetic construct
gacgtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatgtactacgcagactctgtgaagggccgattcaccatctccagagacaacgccaagaactcactatatctgcaaatgaacagcctgagagccgaggacacggctgtttattactgtgcgagagatcgaggtagcagcagctggtacgggggcgatgcttttgatttctggggccaaggaacaatggtcaccgtctcttcag

SEQ ID NO: 2798 - DNA, 346 bp, Artificial Sequence
  Synthetic construct
gacgtgcagctggtggagtctgggggaggcttggtacagcctggagggtccctgagactctcctgtgcagcctctggattcatcttcagtgattatgaaatgaactgggtccgccaggctccagggaaggggctggagtgggtttcatacattgatagtggtggtactaccatatactacgcagactctgtggagggccgattcatcgtctccagagacaacgccgagaactcactatatctgcaaatgaacagcctgacagtcgaggacacggctgtttattactgtgcgagagggggactacggcgaaactggggccagggaaccctggtcaccgtctcctcag

SEQ ID NO: 2799 - DNA, 355 bp, Artificial Sequence
  Synthetic construct
gaggaacaattgatggagtctgggggaggcttggtacagcctggagggtccctgagactctcctgtgtagcctctggattcctcttcagaacttatgaaatgaactgggtccgccaggctccagggaaggggctggagtgggtttcatacattagtagtagtggtggaaccatatactacgcagactctgtgaagggccgattcaccatctccagagacaacgccaagaactcactgtatctgcaattgaacagcctgagagccgaggacacggctgtctattactgtgcgagagatgaccgctacggtgaccttgatttttggggcctgggaaccctggtcaccgtctcctcag

SEQ ID NO: 2800 - DNA, 390 bp, Artificial Sequence
  Synthetic construct
gaggtgcagctggcggagtctgggggaggcttggtacagcctggagggtccctgagactctcctgtgcagcctctggattcaccttcagtagttatgaaatgaactgggtccgccaggctccagggaaggggctggagtgggtttcatacattagtagtactggtagtaccatatactacgcagactctgtgaagggccgattcaccatctccagagacaacgccaagaactcactgtatctgcaaatgaacagcctgagagccgaggacacggctgtttattattgtgcgagagggcccaattactatgatagtagaaatcattactcgccaccactcgaccagtacatggacgtctggggcaaagggaccacggtcaccgtctcctca

SEQ ID NO: 2801 - DNA, 352 bp, Artificial Sequence
  Synthetic construct
gaggtgcagctggtggagtctgggggaggcctggtacagcctggagggtccctgagactctcctgtgcagcctctggattcaccttcagtagtaatgaaatgaactgggtccgccaggctccagggaaggggctggagtgggtttcatacattagtagtggtggttataccatatactacgcaggctctgtgaagggccgattcaccatctccagagacaacgccaagaactccctgtatctgcaaatgaacagcctgagagccgaggacacggctgtttattactgtgcgagcgggaacggtgacttcgtgtacttctggggccagggaaccctggtcaccgtctcctcag

SEQ ID NO: 2802 - DNA, 378 bp, Artificial Sequence
  Synthetic construct
gaggtgcagctggtggagtctgggggaggcttggtacagcctggagggtccctgagactctcctgcgcaacgtctggattcagtttcaggagatatgacatgaactgggtccgccaggctccagggaaggggctggagtgggtttcatacattagtagtagtgctaatgacatttactactcagactctgtgaagggccgattcaccgtctccagagacaacgccaaaaactcactatatctgcaattgaacagcctgagacccgaagacacggctgtttattattgtgcgagagaggacagagctgtggctggtccctggtcctcctactacttcatggacgtctggggcaaagggaccacggtcaccgtctcttca

SEQ ID NO: 2803 - DNA, 343 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagagacgagaacgactactggggccagggaaccctggtcaccgtctcctcag

SEQ ID NO: 2804 - DNA, 358 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagagatacaggatatacccggaaacttgactactggggccagggaaccctggtcaccgtctcctcag

SEQ ID NO: 2805 - DNA, 384 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagagatcactacggtggtaaatccggaagcggatactactactactactacatggacgtctggggcaaagggaccacggtcaccgtctcctca

SEQ ID NO: 2806 - DNA, 342 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagagctttcctggacgtctggggcaaagggaccacggtcaccgtctcctca

SEQ ID NO: 2807 - DNA, 378 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagagggggcgactacgggggaacctgggcgtactactactactacatggacgtctggggcaaagggaccacggtcaccgtctcctca

SEQ ID NO: 2808 - DNA, 382 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagaggtccttattactatgatagtagtagttattacccaaaagaatacttccagcactggggccagggcaccctggtcaccgtctcctcag

SEQ ID NO: 2809 - DNA, 381 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagagttggtgatgatagtagtggttggggttactactactactactacatggacgtctggggcaaagggaccacggtcaccgtctcctca

SEQ ID NO: 2810 - DNA, 364 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagggagaattactatggttcggggagttatttgggctactggggccagggaaccctggtcaccgtctcctcag

SEQ ID NO: 2811 - DNA, 349 bp, Artificial Sequence
  Synthetic construct
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggaagtaccatatactacgcagagtctgtgaagggccgattcaccatctccagagacaacgccaagaactcactgtatctgcaaatgaacagcctgagagccgaggacacggctgtttattactgtgcgaggggttatggttcgggggactactggggccagggaaccctggtcaccgtctcctcag

SEQ ID NO: 2812 - DNA, 376 bp, Artificial Sequence
  Synthetic construct
gacgtgcaattggtggaatctgggggaggcctggtcaagccgggggggtccctgagactctcctgtgttgcctctggattcaacttcagtcattattccatgaactgggtccgccaggctccagggaggggcctggagtgggtcgcaaccatcagcagtattagcaattacatttattatgtagattcagtgaagggccgattcaccatctccagagacaacgccaagaactcactgtatctgcaaatgaatagcctgcgagccgaggacacggcagtatattactgtgcgagagttgggagtctttttgaactaaatggccgggagtcgggtctcgacccctggggccagggaactctggtcaccgtctcctcag

SEQ ID NO: 2813 - DNA, 356 bp, Artificial Sequence
  Synthetic construct
ggggtctgggggagccttggtacagcctggagggtccctgcgactctcctgtttaggatctggattcaccttcagtagttttgaaatgaactgggtccgccaggctccagggagggggctggagtgggtctcacatatcagtagtggggggagtaccacaaactacgcagactctgtgaagggccgattcaccgtctccagagacaacgccaagaactcattgcatctgcaaatgaatagcctgagagccgaggacacggcggtttattattgtacgagagttttcggattttcggcttggaacttcggtgacttttactactggggccagggaacccgcgtcaccgtctcctcag

SEQ ID NO: 2814 - DNA, 382 bp, Artificial Sequence
  Synthetic construct
gaggtgcagctggaggagtctgggggaggcttggtacagcctggagggtcccggagactctcctgtgcagcctctggattcaccttcagtagttatgaaatgaactgggtccgccaggctccagggatggggctggagtgggtttcatacattagtagtagtggtagtaccatttactacgcagactctgtgaagggccgattcaccatctccagagacaacgccaagaactcactgtatctgcaaatgaacagcctgagagccgaggacacggctgtttattactgtgcgagagatcccctttattactatgatagtggtggttattaccatgatgcttttgatatctggggccaagggacaatggtcaccgtctcttcag

SEQ ID NO: 2815 - DNA, 361 bp, Artificial Sequence
  Synthetic construct
gaggtgcagctggtggagtctgggggaggcttggtacagcctggagggtccctgagactctcctgtgccgcctctggattcaccttcagtagttatgagatgaactgggtccgccaggctccaggggaggggctggagtggattgcatacattagtagtactagttttcccatctattacgcagactctgtgaagggccgattcaccatctccagagacaacgccaagaattcagtttttctacagatggacaacctgagagccgaggacacggctgtctattactgtgcgagtcgccccgaatatacgtttggttactttgactcctggggccagggaaccctggtcaccgtctcctcag

SEQ ID NO: 2816 - DNA, 358 bp, Artificial Sequence
  Synthetic construct
gaggtgcagctggtggagtctggggggggcttggtaaagcctggagggtccctgagactctcctgtacaggctctggattcaccttcagtgattatgaaatgaactgggtccgccaggctccgggggaggggctggagtgggtttcattcattggaagtagtagtagtgtcatacactacgcagactctgtgaagggccgattcaccatctccagagacaacgccaagaacgcactgtatctacaaatggagagcctgagagccgacgacacggctgtttatttctgtgcgagagacatagactggaactacggacttgactcctggggccagggaaccctggtcaccgtctcctcag

SEQ ID NO: 2817 - DNA, 373 bp, Artificial Sequence
  Synthetic construct
gaggtgcagttggtggagtctgggggaggcttggtacagcctggagggtccctgagactctcctgcacagcccctgagttcaccttcagtaattatgaaatgaactgggtccgccaggctgcagggaaggggctggagtgggtttcatatattagtgatagtgggaggaccatatactacgcagactctgtgaagggccggtttatcatttccagagacaaagccaagaattcactgtatctgcaaatgaatagcctgagggtcgaggacacggctgtttattactgtgcgaaagtgggcaaccgggtcccgacgaggaggggtggggcttttgatatttggggccaagggacaatggtcaccgtctccttag

SEQ ID NO: 2818 - DNA, 382 bp, Artificial Sequence
  Synthetic construct
gaggtgcagctggtggagtccgggggcggcctggtcaagcctggggggtccctgagactctcctgtgtagcctctggattcaccttcagtagttataccatgaactgggtccgccaggttccagggaaggggctggagtgggtctcatccattagtagcagtgatagttacatatcctacgcagactcagtgaagggccgattcaccatctccagagacaacgccaagaactcactatatctccaattgaacagcctgagagtcgaggacacggctctatattactgtgcgagagatcgggcacactgtactaatagcagctgcttttcggggggctggttcgactcctggggccagggaaccctggtcaccgtctcctcag

SEQ ID NO: 2819 - DNA, 382 bp, Artificial Sequence
  Synthetic construct
gaggtgcaactggtggagtctgggggcggcctggtcaagcctggggggtccctgagactctcctgtgcaggctctggattcagcttcagtgcctatagcatgaactgggtccgccggactccagagaagggcctggagtgggtcgcatccattagttttcgtagtcatttcatatacatcgcagactcagtgaagggccgattcaccgtctccagagacaacgccaagagcactctgtttctgcagatgaacgacctgagagccgacgacacggcatattattactgtgcgagaggttgggtggggcaggaccccactgcttaccgcacagggggctactttgactcctggggccggggaaccctggtcaccgtctcctcag

SEQ ID NO: 2820 - DNA, 382 bp, Artificial Sequence
  Synthetic construct
gaggtgcaactggtggagtctgggggaggcctggtcaagcctggggggtccctgagactctcctgtgcagcctctggcttctccttcggtgcttatggcatgaactgggtccgctgggctccagggaaggggctggagtgggtcgcatccattaatagttatagcagtcacatatattatgtagactcagtgaagggccgattcaccatctccagagacaacgccaagagctcattgtatctgcaaatgaccagcctgagcgccgaggacacggctgtttattactgtgcgagagatttggacggttactatggttcgggaagttattatcccgatgcttttgatatctggggccaggggacaaaggtcaccgtctcttcag

SEQ ID NO: 2821 - DNA, 366 bp, Artificial Sequence
  Synthetic construct
caggtccagctggtgcagtctggggctgaggtgaagaagcctgggtcctcggtgaaggtctcctgcaaggcttctggaggcaccttcagcagttatgctatgaactgggtgcgacaggcccctggacaagggcttgagtggatgggatggatcatccctatctttggaacagcaaactacgcacagaagttccagggcagagtcacgattaccgcggacgagtccacgagcacagcctacatggagctgagcagcctgagatctgaggacacggccgtgtattactgtgcgagagtggtcggcagcagctcctactactaccacattgacgtctggggcaaagggaccacggtcaccgtctcctca

SEQ ID NO: 2822 - DNA, 360 bp, Artificial Sequence
  Synthetic construct
caggtccacctggtggagtctgggggaggcttggtcaagcctggagggtccctgagactctcctgtgcagcctctggattcagctttagtgactactacatgaagtggatccgccaggctccagggaaggggctggagtgggtttcatacattagtggcagtggggataccatctactacgcagactctgtgaagggccgattcaccatctccagggacaacgccaagaactcactgtttctgcaaatggacagcctgagagccgaggactcggctgtgtattactgtgcgagagggggagaatcttactactggtacatggacgtctggggcaaagggaccacggtcaccgtctcctca

SEQ ID NO: 2823 - DNA, 369 bp, Artificial Sequence
  Synthetic construct
gaggtgcagctggtggagtctgggggaggcttggtcaagcctggagggtccctgagactctcttgtgcagtttctggattcaccttcagtgactattctatgaattggattcgccaggctccagggaaggggctggagtggctttcatatattagtcctactggtagtaccggaaatgtcgcaggctctgtgaggggccgattcaccatgtccagggacaacgccaagaattccctgtatctgcaaatggacagcctgacagtcgaggacacggctgtctactactgtgcaagagaagcccgctatggttcggggagcccttggtacatggacgtctggggcaaagggactacggtcaccgtctcctca

SEQ ID NO: 2824 - DNA, 367 bp, Artificial Sequence
  Synthetic construct
gaggtgcagctggtggagtctgggggaggcctggtcaagcctggggggtccctgagactctcctgtgcagcctctggattcaccttcagcagcaatagcatgaattgggtccgccagactccagggaaggggctggagtgggtctcgtccattactagtgatgggaattacatatcttacgcagactcagtgaagggccgattcaccatctccagagacaacgccaagaactcactgtttctgcaaatgaacagcctgagagccgacgacacggctgtttattactgtgcgagagccatagagatgtctactacggatggtgctttagatctctggggccaagggacaatggtcaccgtctcttcag

SEQ ID NO: 2825 - DNA, 360 bp, Artificial Sequence
  Synthetic construct
gaggtgcgattggaggagtctgggggaggccacattgagccgggggggtccctgagactctcgtgttcagcctctggattcaccttcagtgcattctacatgaattgggtccgccaggctccagggaagggactggagtgggtcgcttccatcagtggcagtggaacgacgatatattcctcagactcagtgaagggccgattcaccatttccagggacaatgccaagagattattgtctttagaaatggaaggtctgagggacgacgactcgggtgtctattactgtgtgcgtgctgacgactcttatcactactacatgttggactggggcaaagggaccacggtcaccgtctcctct

SEQ ID NO: 2826 - DNA, 385 bp, Artificial Sequence
  Synthetic construct
gacgtgcaactggtggagtctgggggaggcttggtacagcctggagggtccctgagactctcctgtgcagtctctggattcatcttcagatcttatgcaatgaattgggtccgccaggctccagggaaggggctggaatgggtctcatacattagtcgtactgggactatcatatatgatgcagattctgtgaagggccgattcaccatctccagagacaacgccaagaattcactgtatctgcaaatgaacagcctgagagccgaggacacggctatttattactgtgtgagagataattactttgatagtagtggttattacctttacggaccccactactttgactactggggccaaggaaccctggtcaccgtctcctcag

SEQ ID NO: 2827 - DNA, 382 bp, Artificial Sequence
  Synthetic construct
gaggtgcaactggtggagtctgggggaggcttggtgcagcctggcgggtccctgagactctcctgtacagcctctggattcattttcaatacttatgaaatgaattgggtccgccaggctccagggaggggactggagtggatttcatacattggttctagtggaagtaccatatactacgcagactctgtgaagggccgattcaccatctccagagacaacgccaacaactcactgtatctgcaaatgaacagcctgagagccgaggacacggctgtttattattgtgcgaggttccacagggaaacatactgtggtggtgattgctattcggggacttttgatgtctggggccgagggacaatggtcaccgtctcttcag

SEQ ID NO: 2828 - DNA, 387 bp, Artificial Sequence
  Synthetic construct
gaggtgcagttggtggagtctgggggagccttggtccagcctggagagtccctcagactctcttgtgaagcctctggattcaccttcaaaagttttgagatgaattgggtccgccaggctccagggagggggctgcagtggcttgcattcattagtggtaatggtgacaccatctactacgcggactctgtgaagggccgattcaccatatccagagacaacgccaagaattcagtgtttctagaagtgagcagcctgagagccgaagacacggctctgtactactgtgtgaggggggccccacattcgcagtataccagtttttggttctatagttactacttcatggacgtctggggcaacgggaccacgatcactgtctcctca

SEQ ID NO: 2829 - DNA, 361 bp, Artificial Sequence
  Synthetic construct
gaggtgcagctggtggagtctgggggaggcttggtgaagcctggggggtcccttagactctcctgtgcagcctctggattcaatttcactaacgcctggatgaattgggtccgccaggctccagggcaggggctggactgggtcggccgtattaaaagcgaaactgatggtgggacaacagaccacgctgcacccgtgaaaggcagattcaccatctcaagagatgattcaaaaaacaccctgtttctgcaaatggacagcctgaaaaccgaggacacagccatttattactgtaccacagtacataccattaggggctttgactactggggccagggaaccctggtcaccgtctcctcag

SEQ ID NO: 2830 - DNA, 364 bp, Artificial Sequence
  Synthetic construct
gcggttcaactggtggaatctgggggaggcctggttcagcctggagggtccctgagactctcctgtgcagcctctggattcaacttcagtagttatgaaatgaattgggtccgccagtctccagggaaggggctggagtgggtttcatacatcagtagttctgggagtatgatatactatgcagactctgtgaagggccgattcaccatctccagagacaacgccaagaagtccgtgaccctgcaaatgaatagtctgaaagtggaggatacggctctttacttctgtgtgcgagcttggcagcaactggtatggggaggtcttgatatctggggccaagggacactggtcaccgtcgcctcag

SEQ ID NO: 2831 - DNA, 378 bp, Artificial Sequence
  Synthetic construct
gaggtgcagctggtggagtctgggggaggcctggtcaagcctggggggtccctgagagtctcctgtgcagcctctggattcacctttagtagttatagtatgaattgggtccgtcaggctccagggaaggggctagagtgggtcgcatccataactcgccgtgggacttacatctactacctagactcagtgaagggccgattcaccatttccagagacaacgcccagaactcactgcatctgcaaatggacagcctgagagccgaggacacggctgtctattactgtgcgagagatctccgagatgagagtgttgacgagtactactattactacatggacgtctggggcaaagggaccacggtcaccgtctcctca

SEQ ID NO: 2832 - DNA, 375 bp, Artificial Sequence
  Synthetic construct
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagagaagggatggctacaaggggttactactactactactacatggacgtctggggcaaagggaccacggtcaccgtctcctca

SEQ ID NO: 2833 - DNA, 355 bp, Artificial Sequence
  Synthetic construct
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagagacctcgtagtaggtgcttttgatatctggggccaagggacaatggtcaccgtctcttcag

SEQ ID NO: 2834 - DNA, 393 bp, Artificial Sequence
  Synthetic construct
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagaggccatgatagtagtggttattacttttttttgggggtgggctactactactactacatggacgtctggggcaaagggaccacggtcaccgtctcctca

SEQ ID NO: 2835 - DNA, 379 bp, Artificial Sequence
  Synthetic construct
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagaggtcttatagcagatagtagtggttattacaagttacggctatttgactactggggccagggaaccctggtcaccgtctcctcag

SEQ ID NO: 2836 - DNA, 361 bp, Artificial Sequence
  Synthetic construct
caggtgcagctggtgcaatctgggtctgagttgaagaagcctggggcctcagtgaaggtttcctgcaaggcttctggatccaccttcactacctatgctatgaattgggtgcgacaggcccctggacaagggcttgagtggatgggatggatcaacaccaacactgggaacccaacgtatgcccagggcttcacaggacgatttgtcttctccttggacacctctggcagcacggcatatctgcagatcagcagcctaaaggctgaggacactgccatatattactgtgcgagatcaccaacgggttatccctactactttgactactggggccagggaaccctggtcaccgtctcctcag

SEQ ID NO: 2837 - DNA, 361 bp, Artificial Sequence
  Synthetic construct
caggtgcagctggtgcaatctgggtctgagttgaagaagcctggggcctcagtgaaggtttcctgcaaggcttctggatacagcttcaatatctatgctatgaattgggtgcgacaggtccctggacaagggcttgagtggatgggatggatcaacaccaaaactgggaacccgacgtacgcccagggcttcactggacggtttgtcttctccttggacagctctgtcagtacggcatatctgcagatcaccagcctaaaggctgaggacactgccatgtattactgtgcgagagatcctgactatgatactagtggtccagactactggggccagggaaccctggtcactgtctcgtcag

SEQ ID NO: 2838 - DNA, 361 bp, Artificial Sequence
  Synthetic construct
caggtgcggttggagcagtctggatctgagttgaagaagcctgggacctcagtgaaggtttcctgcaaggcttctggatacagcttcatcacatatgctatgaattgggtgcgacaggtccctggacaagggcttgagtggatgggatggatcaacaccaacactgggaggccaatgtatgcccagggcttcacaggacggtttgtcttctccttggacacgtctgtcaacacggcatatttggagatcactagcctgaagactgaggacagtgccgtttattactgtgcgagagatgatggaggggggtactggggcttagacctctggggccaggggaccctggtcaccgtcccctcag

SEQ ID NO: 2839 - DNA, 397 bp, Artificial Sequence
  Synthetic construct
caggtgcagctggtgcaatctgggtctgagttgaagaagcctggggcctcagtgaaggtttcctgcaaggcttctggatacaccttcactaattatgctatgaattgggtgcggcaggcccctgggcaagggcttgagtggatgggatggatcaacaccaaaactgggaacgcaacttatgcccagggcttcacaggacgctttgtcttctccatggacacctctgtcagcacggcatatctgcagatcagcagcctaagggctgctgatagtgccgtgtattattgtgcgtccctaggacattgtcgtagtggcagctgtttagtccgaccagctgaggtctcgcagacctggttcgacccctggggccagggaaccccggtcaccgtctcctcag

SEQ ID NO: 2840 - DNA, 370 bp, Artificial Sequence
  Synthetic construct
gaggtgcaactggtggagtctgggggaagtgtggtacggcctggggggtccctcagactctcctgtacagcctctggattcacctttggcgattatggcatgacctgggtccgccaagctccagggaagggcctggagtgggtcgctggtataaattttagtggtggtgtcaccagttatgcagactctgtgaagggccggttcaccatctccagagacaacgccaagaactccctccatctgcaaatgaacagtctgagagccgaggacacggccttgtattactgtgcgaaagatcgcagcctctccggatatagcagcagttgccacctcgactggggccagggaaccctggtcaccgtctcgtcag

SEQ ID NO: 2841 - DNA, 370 bp, Artificial Sequence
  Synthetic construct
ggggtgcaattggtggagtctgggggaggtgtgatacggccgggggggtccctgagactctcctgtgcagcctccggattcagatttgatgattatgccatgacctgggtccgccaagttccagggaaggggctgcagtgggtcgctggcatcgattggaatggagagaattcgggttatgcagactctgtgaagggccgcttcaccatctccagagacaacgccaagaattccgtctttctacaaatgaacagtttgagagccgaggacacggccctctattactgtgcgagaggcctttatgagggatttgaatcaagtggtttttacagattctggggccagggaacctgggtcaccgtctcctcag

SEQ ID NO: 2842 - DNA, 361 bp, Artificial Sequence
  Synthetic construct
gaggtgcagctggtggaatctgggggaggcttggtgcagcctggggggtccctgagactctcctgtgcagcctctggattcacctttagcagatatgccatgacctgggtccgccacgctgcagggaaggggctgcagtgggtctcagttataactgatagtggtgcgagcacagactacgcagactccgtgaagggccggttcaccatctccagagacaattccaagaacacactgtatctgcacatgtacagcctgagagccgaggacacggccctgtattactgtgttaaagctgagggcccgtatggtggctactttgaccaatggggccagggaacccaggtcaccgtctcctcag

SEQ ID NO: 2843 - DNA, 361 bp, Artificial Sequence
  Synthetic construct
gaggtgcagctgttggagtctgggggaggcttggtacagcccggggggtccctgagactctcctgtgcagtctctggattcacctttagcagctatgccatgacctgggtccgccaggctccaggaaaggggctggagtgggtctcaactattagtggtagtggtggtaatacatattacgcagactccgtgaagggccggttcaccatctccagagacaattccaagaacacactttatctgcaaatgaacagcctgagagccgaggacacggccgtatattactgtgcgaaagtgaagtttggctatggctcccattttgatatctggggccaagggacaatggtcaccgtctcttcag

SEQ ID NO: 2844 - DNA, 373 bp, Artificial Sequence
  Synthetic construct
gaggtgcaactggtggagtctgggggaggcttggttcagccagggcggtcccttagactctcctgtacagcttctgcattcatctttggtgattatgctatgacctgggtccgccaggctccagggaagggactggagtgggtaggtttcattagaagcaaagctaccggtgggacagcagaatacgccgcgtttgtgaaaggcagattcaccatctcaagagctgattccaaaagcatcgcctatctgcaaatgaacagcctggaaaccgaggacacagccgtgtattactgtgctagagtagaatcgtactactatgacagtagtgctgttgactactggggccagggaaccctggtcaccgtctcctcag

SEQ ID NO: 2845 - DNA, 373 bp, Artificial Sequence
  Synthetic construct
gaggtgcagttgttggagtctgggggaggcttggtgcagcctggggggtccctgagactctcgtgtgcagactctggattcacctctggcacctatgccatgacctgggtccgccaggctccagggaaggggccggagtgggtctcaagtattagtgaaagtggtggtagcacatactacgcagactccgtgaagggccggttcagcatctccagagacaaaaccaagaacaccctatatctgcaaatgaccagcctgagagccgaagacacggccgtatatttctgcgcgaaatacaaccctcggggctacggtgactacgcggggtacctcgacccctggggccagggaaccctggtcaccgtctcctcag

SEQ ID NO: 2846 - DNA, 367 bp, Artificial Sequence
  Synthetic construct
gaggtgcagttgttggagtctgggggaggcttcgtacactctggggggtccctgagactctcctgtgcagcctctcaattcacctttggcgactatgccatgacctgggtccgccaggctccagggaaggggctggaatgggtctcagttattagtggtagtggttctagcacattttacgcagactccgtgaagggccggttcaccatctccagagacaattccaagaatacgctgtttttgcaaatgaacagcctgagagccgacgacacggccgtatatttctgtgcgaaaatcaggccaatgactacggtgacgagctcctttgactactggggccagggaaccctggtcaccgtctcctcag

SEQ ID NO: 2847 - DNA, 376 bp, Artificial Sequence
  Synthetic construct
gaggtgcagctggtggagtctgggggaggcttggtccagcctggggggtccctgagactctcctgtgtagcctctggaatcacttttagtaactattggatgacctgggtccgccaggctccagggaaggggctggagtggatggcctgcataaaccaggatggaactgagacatattatgtggactctatggagggccgattcaccatctccagagacaacaccctgaactcagtgtttctgcaaatgaagagcctgagagccgaggacacggctgtgtattactgtgcgagagataccgctacattacgaagtcacgggggggccggctggttcgccccctggggccagggaaccctggtcaccgtctcctcag

SEQ ID NO: 2848 - DNA, 370 bp, Artificial Sequence
  Synthetic construct
gaggtgcagctgttggagtctgggggaggcatggtacagcctggggggtcccggagactctcctgtgcagcctctggattcacctttagaagctatggcatgacctgggtccgccaggctccagggaaggggctggagtgggtctcaactattattaatagtggtgggagcacatactacgcagactccgtgaagggccggttcaccatctccagagacaactccaagaacacgctttatctgcaaatgaacaccctgagagccgaagacacggccgtatattactgtgcgaaaccggggggctatggttcggggagtgatggtgcttttgatatctggggccaagggacaatggtcatcgtctcttcag

SEQ ID NO: 2849 - DNA, 367 bp, Artificial Sequence
  Synthetic construct
gaggtgcagttgttggagtctgggggaggcttggtacagccgggggggtccctaagactctcctgttcaatgtctggattcacgtttggcagttttgccatgacctgggtccgccaggctccagggaaggggctggagtgggtctcaagcattagtcgcagtggtgatgcaacatactacgcagactttgtgaagggccggctcatcatctccagagacaattccaagagtaggctgtatctgcaaatgagcagcctgagagtcgaggacacggccgtatattactgtacgaatattcgagacgcatacagtgtcggttatggacttgattcctggggccagggagtcctggtcaccgtctcctcag

SEQ ID NO: 2850 - DNA, 364 bp, Artificial Sequence
  Synthetic construct
gaggtgcaactggcggagtctggggggcgcttagtccgcccgggggagtccctgagactctcctgtgcagcctctggattcacatttaacaattatgccatgacctgggtccgccaggctccagggaaggggctggagtgggtctcaagtattagcgggagcgctggtaggacatactacgcagactccgtgaggggccgcttcaccatctccagagacaattccaggaacattctgtatctggaaatgcacaacctgagtctcgacgacacggccacatattactgtgcgaaaaggcaggcttatagcagctcgtcccccttgggccactggggccagggaaccctggtcaccgtctcctcag

SEQ ID NO: 2851 - DNA, 372 bp, Artificial Sequence
  Synthetic construct
gaggtgcagctggtggagtctgggggaggcttggtacaccctggggggtccctgagactctcctgtgcagcctctggattcacctttagcgactatgccatgacctgggtccgccaggctccagggaaggggctggagtgggtctcagctattagtggtagtggttctagcacattctacgcagactccgtgaagggccggttcaccatctccagagacaattccaagaacaccctgtatctggaagtgaacagcctgagagccgacgacgcggccgtttattactgtgcgaaagatgtcagcaactacgggatttactattactactacatggacgtctggggtaaagggaccacggtcaccgtctcctca

SEQ ID NO: 2852 - DNA, 364 bp, Artificial Sequence
  Synthetic construct
gaggtgcagctggtggagtctgggggaggcttggtccagcctggggggtccctgagactctcctgtgcagcctccggattcatctttagtaactattggatgacctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagttcggatgactacagtaactacggtccatttgactactggggccagggaaccctggtcaccgtctcctcag

SEQ ID NO: 2853 - DNA, 364 bp, Artificial Sequence
  Synthetic construct
gaggtgcagctggtggagtctgggggaggcttggtccagcctggggggtccctgagactctcctgtgcagcctcgggattcatctttagtaactattggatgacctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagttcggatgactacagtaactacggtccatttgactactggggccagggaaccctggtcaccgtctcctcag

SEQ ID NO: 2854 - DNA, 370 bp, Artificial Sequence
  Synthetic construct
gaggtgcagctggtggagtctgggggaggcttggtccagcttggggggtctctgagactctcctgtgcagcctctggattcacctttagaagcttttggatgacctgggtccgccaggctccagggaaggggctggagtgggtggccaacataaagtcagatggaagtgagaaatcctatgtggactctgtgaggggccgattcaccatctccagagacaacgccaagaactcactgtacctgcaaatgaacagcctgagagccgaggacacggctgtgtattactgtgctagaggtccccccagtggatacacctttggttcctactttgactcctggggccagggaaccctggtcaccgtctcctcag

SEQ ID NO: 2855 - DNA, 370 bp, Artificial Sequence
  Synthetic construct
gaggtgcagctggtggagtctgggggaggcttcatacagcctggagggtccctgagactctcctgtgcagcctctggattcaccttcaatagttatgaaatgacctgggtccgccaggctccagggaaggggctggagtgggtttcacacattgctagtagtggtagaaccatatactacgcagactctgtgaagggccgattcaccatctccagagacagcgccaagaagtcagtccatctgcaaatgaacagcctgagagtcgaggacacggctctttattactgtgcgagaggagtcactagtggttaccactcttaccccctccttgacttctggggccagggaaccctggtcaccgtctcctcag

SEQ ID NO: 2856 - DNA, 387 bp, Artificial Sequence
  Synthetic construct
gaggtgcacctggtggaatcggggggagccgtggtacagccagggcggtccctgagactctcctgtacaggcactggattcacttttgacgactatgctatgacctgggtccgccaggctcccgggaaggggctggagtgggtaggtctcattaaaggcaaagattttggcgggaaaacagaatttgccgcgtctgtgaaaggcagattctccatctcaagagaagactcgaaaggcatcgcccatctgcaaatgaacagtctgaaaaccgaggacacagccgtgtacttctgtgcccgagctcggggaacatataactgggactctggggcctactcttacttcatggacgtctggggcaaagggaccgcggtcaccgtctcctca

SEQ ID NO: 2857 - DNA, 367 bp, Artificial Sequence
  Synthetic construct
gaggtgcagttgttggagtctgggggagacttggtacaccccggggggtccctgagactctcctgtgcagcctctgaattcacttttggcgactatgccatgacctgggtccgccaggttccagggaaggggctggagtgggtctcagttattagtgggagtggttccaggatattttacgcagactccgtgaagggccggttctccatctccagagacaattccaagaacactctatttttgcaaatgaacagcctgagagccgacgacacggccatttatttctgtgcgaaaattaggccaatgactacggtgacgagcgcgtttgacctctggggccagggaacccaggtcaccgtctccgcag

SEQ ID NO: 2858 - DNA, 355 bp, Artificial Sequence
  Synthetic construct
gaagtgaaactggtagaatctgggggaggcttggtccagccgggggggtccctgagactctcctgtgaagcctctggattcagttttacttcgttttggatgacgtgggtccgccaggctccagggaaggggctggagctgctgggcaacataaacctagacggaagtttccaaacctatgtggactccattaggggccgattcttcatctccagagacaacgccaggaactcagtgtacctgcacatgaacagcctgagagtcgacgacacggctatctattactgtggaagagatccgggatacagtagcttggacgtctggggcacaggcattatggtcacagtctcctcag

SEQ ID NO: 2859 - DNA, 387 bp, Artificial Sequence
  Synthetic construct
gaggtgcagctggtggaatctgggggaggcttggtacagccagggcggtccctgagactctcctgtaaagcctctggattcagttttgatgattatgccatgacgtgggtccgccaggctcccgggaaggggctggagtgggtaggtctcattaaaagcagagcttatagtgggacgacagaatatggcgcgtccgtgaaaggcagattcaccatctcgagagatgatcccaaaagcatcgcctatctgcaaatgaccaccctgaaaaccgacgacacagccgtgtacttctgtgctcgaggtcggggaacctatgactggaactccggggcctactactacttcatggacgtgtggggtaaagggaccacagtcaccgtctcctca

SEQ ID NO: 2860 - DNA, 399 bp, Artificial Sequence
  Synthetic construct
gaagggcagctggtggagtctgggggaggcctcgtccaggcgggggggtccctgagaatttcctgtgcggcctctggattcaggtttggtgaacattacatgacgtgggtgcgccagactcaagggaagaggctggaatgggtggccagcataaaacaggattcaggcgcgagattttatgcggactctgtgaagggccgattcagcatttcgagaaacaatggttataatactttgactctcgaaatgagaaacctgagagtcgacgacacggctgtctactattgcacgagaggaggcggccatttgctccgggcaggctatgagtggtccccgggagatcaaacattccacttcatgaacgtctggggcaaggggaccacggtcttcgtctcctca

SEQ ID NO: 2861 - DNA, 352 bp, Artificial Sequence
  Synthetic construct
caggtgcagctggtggagtctgggggaggcttggtcaagcctggagggtccctaagactctcctgtgcagtctctggattcaccgtcactgaccaattcatgacttggatccgccaggctccagggaagggcctggagtgggttgcgtacattgatagtggtgttaggcccctatattacgcagactctgtgaagggccgattcaccatctccagggacaacgccaacaattccttgtatctacaaatgaccagcctgagagccgacgacacggctgtctattattgtgcgacttatcccacgggcattttgaactcctggggccagggaaccctggtcaccgtctcctcag

SEQ ID NO: 2862 - DNA, 361 bp, Artificial Sequence
  Synthetic construct
caggtgcgactggtggagtctgggggaggcttggtcgagcctggagggtccctgagactctcctgtgcagcctctggattcaccttcagtggttcctacatgacttggatccgccaggctccagggaaggggctggagtggatttcatatattagtcaaagtggcagcaggaaatactacgcagactctgtggagggccgattctccatctccagggacaacgccaggaactcactatttttgcaaatgaacagcctgagagtcggagacacggctgtatattactgtgcggcctcttacaatatccagggtttggtccttgactactggggccagggatccctggtcaccgtctcctcag

SEQ ID NO: 2863 - DNA, 367 bp, Artificial Sequence
  Synthetic construct
gaagggcagttgtcggagtccgggggaggcttggttcagccgggggggtccctgagactctcctgtgcagcctctggattcaccttcggccgccatgccatgacttgggtccgccaggcgccagggaaggggctggagtgggtcgcaagtgttgacgaaactgccactggcacatactacgcggactccgtgaagggccggttcaccatctccagagacaactccaagaatacactatatctgcagatgaacagcctgagagccgaggacacggccctgtattactgtgcgaaacacaaaggggagtcctatatttcttgggctcttgatttgtggggccaagggacattggtcaccgtctcttcag

SEQ ID NO: 2864 - DNA, 376 bp, Artificial Sequence
  Synthetic construct
gaggtgcaactgttggagtctgggggaggcttggtacagcctggggggtccctgagaatctcctgtgcagcctctggattcatcttcaataactatgccatgacttgggtccgcgagactccagggaaggggctggagtgggtctcaggtattagtgctagtggtggaaacacatactacgcagactccgtgaagggccgcctcaccatctccagagacaataccaagaacacactgtttctgcaaatgaacagcctgagagtcgaggacacggccgtctattattgtgcgaaaaccccctcaagaagtgtaagcagtagctggccctattactttgactattggggccagggaacccgggtcaccgtctcctctg

SEQ ID NO: 2865 - DNA, 387 bp, Artificial Sequence
  Synthetic construct
caggtgcagctggtggagtctgggggaggcttggtcaagcctggagggtccctgagactctcctgtgcagcctctggattcaccttcagtgactactacatgagctggatccgccaggctccagggaaggggctggagtgggtctcatacattagtagtagtggtagtaccatatactacgcagactctgtgaagggccgattcaccatctccagggacaacgccaagaactcactgaatctgcaaatgaatagcctgagagccgaggacacggctgtatattactgtgcgaggaacgtatattgtagtggtggtagctgctactccgactactactactactacatggacgtctggggcaaagggaccacggtcaccgtctcctca

SEQ ID NO: 2866 - DNA, 370 bp, Artificial Sequence
  Synthetic construct
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggctgtgtattactgtgcgagaccagaaagtgggagctactactcgccctggttcttcgaatgctggggccagggaaccctggtcaccgtctcctcag

SEQ ID NO: 2867 - DNA, 364 bp, Artificial Sequence
  Synthetic construct
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggctgtgtattactgtgcgagagacaagtatagtgggaccacggatgcttttgatatctggggccaagggacaatggtcaccgtctcttcag

SEQ ID NO: 2868 - DNA, 367 bp, Artificial Sequence
  Synthetic construct
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggctgtgtattactgtgcgagagacccacgagcgtataccgatccccgctggttcgacccctggggccagggaaccctggtcaccgtctcctcag

SEQ ID NO: 2869 - DNA, 361 bp, Artificial Sequence
  Synthetic construct
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtaataccatatactacgcagactctgtgaagggccgattcaccatctccagggacaccgccaagaactcactgtatctgcaaatgaacagcctgagagccgaggacacggctgtgtattactgtgcgagagcgggggggttcatggttcggggactcgactactggggccagggaaccctggtcaccgtctcctcag

SEQ ID NO: 2870 - DNA, 379 bp, Artificial Sequence
  Synthetic construct
caggtgcaactggtggagtctgggggaggcttggtcaagcctggagggtccctgagactctcctgtgtaggctctggattcaccttcggagactacgacatgagctggatccgccaggctccagggaaggggttggagtggctttcatatattagtagcagtggtagtaccaagagttacgcagactctgtgaagggccgattcaccatctccagggacaacgccaagagctcactgtttctggaaatgaacaccctgagagccgaggacacggctgtgtacaactgtgcgagagaaataagaggcgtgggctatagtagtggttattacggctggttcgacccctggggccagggaaccctggtcaccgtctcctcag

SEQ ID NO: 2871 - DNA, 360 bp, Artificial Sequence
  Synthetic construct
caggtgcaactggtggagtctgggggaggcttggtcaagcctggagggtccctgagactctcctgtgcagcctctggattcgacttcagtgactactacatgagctggatccgccaggctccggggaaggggctggagtgggtgtcatacattagtagtagtggcaacaccaaatactacgcagactctctgttgggccgcttcaccgtctccagggacaacgccaagaactctctgtatctgcaaatgagcagcctgagatccgacgacacggctgtgtattactgtgcgagagtccgtacgtccctctactactacatggacgtctggggcaaagggaccacggtcaccgtctcctca

SEQ ID NO: 2872 - DNA, 367 bp, Artificial Sequence
  Synthetic construct
caggtgcagctggtggagtctgggggaggcttggtcaagcctggagggtccctgagactctcctgtgcagcctctggattcaccttcagggactactacatgagctggattcgccaggctccagggaaggggctggagtgggtttcatacattagtagtagtggaagtaccacatactatgcagactctgtgaagggccgattcaccatctccagggacaacgccaacaactcactgtatctgcaaatgaacagtctgagagccgaggacacggctatatattactgtgcgagagatggtgtactactacgaagcttaaagcggttcgacccctggggccagggaaccctggtcaccgtctcctcag

SEQ ID NO: 2873 - DNA, 360 bp, Artificial Sequence
  Synthetic construct
gaggtgcagttggtggagtctgggggaagtgtggtacggccgggggggtccctgagactctcctgtgcagccgctggattcaggtttgatgattatggcatgagctgggtccgccaagttccagggaaggggctggagtgggtctctggtattaattggtatggagaaaggacaggttatgcagactctgtgaaggaccgattcgccatctccagagacaatggcaagaactccctatatctggaattgaacagtctgggggtcgaggacacggccgtctactactgtgcgagagggtgggcaacagatggctactacatggacctctggggcaaagggaccacggtcaccgtctcctca

SEQ ID NO: 2874 - DNA, 388 bp, Artificial Sequence
  Synthetic construct
gacgctcaagttttggagtctgggggaggcttggtgcagcctggggggtccctgagactctcctgtgtcgcctctggattcaccttcagcggtgattcaatgagctgggtccgccagactccaggcaagggactggagtgggtcgcaactattactggaagtggtgataacatgttctacggcggctccgtggggggccgcttcaccatttccagagataattccgaaaacatggtttttctacaaatgaacaacctcagaggcgacgacacggccgtatattactgtgcgaaagggggtccagatgcggctgtctggacgaattctcaactctcttttcatccctttgtctcgtggggcccgggatccctggtcaccgtctcctcag

SEQ ID NO: 2875 - DNA, 364 bp, Artificial Sequence
  Synthetic construct
gaggtgcagctggtggagtctgggggaggcttggtacagcctggggggaccctgagactctcctgtgcagcctctggattcacctttagcaactatgccatgagctgggtccgccaggctccagggaaggggctcgagtgggtctcaggtcttaccggtggtggtgctatcacagactacgcagactccgtgaagggtcgattcaccatctccagagacaattccaacaatacgttgtttctgcaaatgaccagcctgagagccgacgacacggccatatattactgcgcgaaagtaagactgatacggcccgaggggttctttgactattggggccagggaaccccggtcaccgtctcctcag

SEQ ID NO: 2876 - DNA, 367 bp, Artificial Sequence
  Synthetic construct
gaggtgcagctgttggagtctgggggaggcttggtacagcctggggggtccctgagactctcctgtgtagcctctggattcacctttagcagctacgccatgagctgggtccgccaggctccagggaaggggctggaatggatctcaggtattagtggtaatggtggtagcacatacgacgcagactccgtgaagggccgattcaccatctccagagacagttccaagaacactctgtttctgcaaatgaatagcctgataaccgaggacacggccgtatatttctgtgcgaaagacctctcttgtggtggtggtagctgtttttcccgggtttctgactactggggccagggaaccttggtcaccg

SEQ ID NO: 2877 - DNA, 403 bp, Artificial Sequence
  Synthetic construct
gaggtgcagctggaggagtctgggggaggcttggtccagcctggggggtccctgagactctcctgtgcagcctctggagtcaacgtcagtagcaactacatgagctgggtccgccaggctccagggaaggggctggagtggatctcaggtctttatggcgttagaagcacatattacgcagactccgtgaagggcagattcaccatctccagagacaattccaagaatatactgtatcttcaaatgaacagcctgagagccgaggacacggctgtgtatttctgtgcgagaggcaaaacttcttactatgatagagacaaaccgttttactatgatagtagtggtaagggtccccactgctttgactactggggccagggatccctggtcaccgtctcctcag

SEQ ID NO: 2878 - DNA, 376 bp, Artificial Sequence
  Synthetic construct
gaggtgcagctggtggagtctgggggaggcttgataaagcctggggggtccctgagactctcctgcgtagcctctggattcactttcagaaacgcctggatgagctgggtccgccaggctccagggaaggggctggagtggattggtcgtattaaaagcaaccttcttggtgcgacagcagaattcggcgcacccgtgaaaggcaggttcaccatctcaagagatgattcaaaaaacacggtgtatctacagatgaacagcctgaaaaccgaggacacagccgtgtattactgtaccacagattggggttcgacgactcattatattcaggcttttgatatctggggccaagggacaatggtcaccgtctcttcag

SEQ ID NO: 2879 - DNA, 373 bp, Artificial Sequence
  Synthetic construct
gaggtgcagctggtggagtctgggggaggcttggtacagccagggcggtccctgagactctcctgtacagcttctggattcacctttggggattttgctatgagctgggtccgccaggctccagggaaggggctggagtgggtaggtttaattagaagtaaagcttatggtgagacaacagaatacgccgcgtctgtgaaaggcagattcaccatctcaagagatgtatccagaagcatcgcctatctgcaaatgaacagcctgaaaaccgaagacacagccctttattactgtactagagattgggactactatgatagtagtggttactccagtcactggggccagggagccctggtcaccgtctcctcag

SEQ ID NO: 2880 - DNA, 385 bp, Artificial Sequence
  Synthetic construct
gaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaccggcggctgatagcagcagctggtacagccgccttacctactttgactactggggccagggaaccctggtcaccgtctcctcag

SEQ ID NO: 2881 - DNA, 364 bp, Artificial Sequence
  Synthetic construct
gaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagagctctccatagagggagcttttgatatctggggccaagggacaatggtcaccgtctcttcag

SEQ ID NO: 2882 - DNA, 379 bp, Artificial Sequence
  Synthetic construct
gaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagatcttctcggggtcttctcggaggggattggttggttcgacccctggggccagggaaccctggtcaccgtctcctcag

SEQ ID NO: 2883 - DNA, 382 bp, Artificial Sequence
  Synthetic construct
gaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagccccggggaggggatttaggtatggttcggggagccactttgactactggggccagggaaccctggtcaccgtctcctcag

SEQ ID NO: 2884 - DNA, 361 bp, Artificial Sequence
  Synthetic construct
gaggtgaaactggaggagtccggaggaggcctggtccagccgggggggtcccaaagactctcctgtgcagcctctggcttcatcgtcactagcaactacatgagctgggtccgccaggctccagggaaggggctggagtgggtcgcagttatgtatcctggtggtttcgcattctatggagactccgtgaagggccgattcaccatctccagacacaattccaacaacacggtgtttcttcaaatgaatagcctgagacctgaggacacggccgtctattactgtgcgagaggggtggctacgacctaccaatatcactttgacttctggggccagggaactttggtcaccgtctcctcag

SEQ ID NO: 2885 - DNA, 376 bp, Artificial Sequence
  Synthetic construct
gaggtgcaactggtggagtctggaggaggcttggtccagcctggggggtccctgagactctcctgtgcagcctctgggttcaccgtcactagcaactacatgagctgggtccgccaggctccagggaaggggctggagtgggtctcaactatttatagtggtggtagtacatattatgcagactccgttaacggccgattcaccatctccagacacaattccaagaacacgctgtatcttcaaatgaacagcctgagagcggaggacacggccgtttattactgtgcgagagatcgcatcagttttacgactggtgtggtcccggactggaacttcgatctctggggccgtggcaccctggtcactgtctcctcag

SEQ ID NO: 2886 - DNA, 376 bp, Artificial Sequence
  Synthetic construct
gaggtgcagctagtggagtctgggggaggcttggtacagccgggggggtccctgagactctcctgtgcagcctctggattcacctttatcaactatcccatgagctgggtccgccaggctccagggaaggggctggagtgggtctcaagtattggtggtagtggtgcttacaaatactacgcagactccgtgaagggccggttcaccatctccagagacaattccaagaacacggtgtatctgcaaatgaacagcctgagagacgaggacacggccgtatattactgtgcgaaacatttaacgaccagtattgttgtggtggtagctgcacgatttgtctcctggggccagggaaccctggtcaccgtctcctcag

SEQ ID NO: 2887 - DNA, 364 bp, Artificial Sequence
  Synthetic construct
gaggtgcaactggtggagtctgggggaaccttggtacagcctggggggtccctgagactctcctgtgcagcctctggattcacctttagcaactatggcatgagctgggtccgccaggctccagggaaggggctggagtgggtctcacatactagtggtagtggtggaagaacatactacgcagactccgtgaagggccggttcaccatctccagagacaattccaagaacacgctgtttttgcaaatgaacagcctgagagccgaggacacggccgtatattactgtgcgaagttggactacagtaacttacgacagagatttgactactggggccagggaaccctggtcaccgtctcctcag

SEQ ID NO: 2888 - DNA, 358 bp, Artificial Sequence
  Synthetic construct
gaggtgcagctgttggagtctgggggaggcttggttcagcctggggagtccctgagaatttcctgtgcagcctctggattcacctttagcagctatgccatgagctgggtccgccaggctccagggaaggggctggagtgggtctcagccattagtggaagtggtgatagtacatatcacgcagactccgtgaagggccggttcaccatctccagagacaattccaagaacactctgtatctgcaaatgagcagcctgagagccgaggacacggccgtatattactgtgcgaaagatccctcctctatagtgggagccttcgactggggccagggaaccctggtcactgtctcctcag

SEQ ID NO: 2889 - DNA, 349 bp, Artificial Sequence
  Synthetic construct
gaggtgcaacttgtggagtctgggggaggcttggtacaaccgggggggtccctgagactctcctgtgcagcctctggattcacatttgacatctatgccatgagctgggtccgccaggctccagggaaggggctggagtgggtctcagctattggtggtagtggtggtcccacagagtacgcagactccgtgaagggccggttcaccatctccagagacaactccaagaacacactgtatctgcaaatgaacagcctgagagccgaggacacggccatatattactgtgcgaagcctatagcaggtcgtccttccgtgggccagggaaccctggtcaccgtctcctcag

SEQ ID NO: 2890 - DNA, 366 bp, Artificial Sequence
  Synthetic construct
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaccgaaggaggaagagccctcatactactacatggacgtctggggcaaagggaccacggtcaccgtctcctca

SEQ ID NO: 2891 - DNA, 355 bp, Artificial Sequence
  Synthetic construct
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagataaacgggctgcccccttagactactggggccagggaaccctggtcaccgtctcctcag

SEQ ID NO: 2892 - DNA, 373 bp, Artificial Sequence
  Synthetic construct
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtcttttactgtgcgaaagattactatggttcggggacttattatatgggagcttttgatatctggggccaagggacaatggtcaccgtctcttcag

SEQ ID NO: 2893 - DNA, 364 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgccagggaggacagcagtggctggtatgatgcttttgatatctggggccaagggacaatggtcaccgtctcttcag

SEQ ID NO: 2894 - DNA, 367 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaacgggggcctgatagtagtgggtcgggcgcttttgatatctggggccaagggacaatggtcaccgtctcttcag

SEQ ID NO: 2895 - DNA, 364 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagggtagtggttattactcaaactggttcgacccctggggccagggaaccctggtcaccgtctcctcag

SEQ ID NO: 2896 - DNA, 373 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcgagggaagatttactatgatagtagtggccaacaggactactggggccagggaaccctggtcaccgtctcctcag

SEQ ID NO: 2897 - DNA, 376 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcgggcattacgatattttgactggttatttgatgcttttgatatctggggccaagggacaatggtcaccgtctcttcag

SEQ ID NO: 2898 - DNA, 361 bp, Artificial Sequence
  Synthetic construct
gaggtgcagctgttggagtctgggggaggcttggtacagcctggggggtccctgagactctcctgtgcagcctctggattcacctttgacaactatgccatgagctgggtccgccaggctccagggaaggggctggagtgggtctcagctattagtgctagtggtactataacatattacgcagactccgtgaagggccggttcaccatttccagagagtattccaagaacagcctgtatctgcaaatgcacagcctcagagccgaagacacggccgtttattactgtgcgaaagccccaggatatagcaatactgcttttgatttctggggccaagggacaatggtcaccgtctcctcag

SEQ ID NO: 2899 - DNA, 367 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagtcggggacgtattacgatattttgactggtatgactactggggccagggaaccctggtcaccgtctcctcag

SEQ ID NO: 2900 - DNA, 364 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaatgggggctatggttcggggagttggactttgactactggggccagggaaccctggtcaccgtctcctcag

SEQ ID NO: 2901 - DNA, 367 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaatcccgattacgatattttgactgtgaactggttcgacccctggggccagggaaccctggtcaccgtctcctcag

SEQ ID NO: 2902 - DNA, 352 bp, Artificial Sequence
  Synthetic construct
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaatcttataggagggtactttggctactggggccagggaaccctggtcaccgtctcctcag

SEQ ID NO: 2903 - DNA, 385 bp, Artificial Sequence
  Synthetic construct
gaggtgcagttggtggagtctgggggaggcttggtacagcctggggggtccctgagactctcctgtgcagcctctggattcggctttagcagctttgccatgagctgggtccgccaggctccagggaaggggctggagtgggtctcagctattagtggtggtggtcgtcacacatactacgcagactccgcgaggggccggttcaccatctccagagacaattccaagaacacagtgtatctgcacatgaacagcctgagagccgaggacacggccgcatattactgtgcgaagacagcatattgtggtggggattgctcttctagagtcactgcatacttctttgactcctggggccagggaaccctggtcaccgtctcctcag

SEQ ID NO: 2904 - DNA, 364 bp, Artificial Sequence
  Synthetic construct
gaggtgcagctggtggagtctgggggaaccttggtacagcctggggggtccctgagactctcctgtgcagtctctggattcacctttagcacctatgccatgagctgggtccgccaggctccagggaaggggctggagtgggtctcaggtatcagtggcagtggtggtaccacatactacgcagactccgtgaagggccggttcaccatctccagagacaattccaagaacacgctgtatctgcaaatgaacagcctgagagccgaggacacggccatatattactgtgcgaaatcccgggcagtggctgggtacgattactttgactactggggccagggaaccctggtcaccgtctcctcag

SEQ ID NO: 2905 - DNA, 364 bp, Artificial Sequence
  Synthetic construct
gaggtgcagctggcggaatctgggggagacttcgtacagccgggggggtccctgagactctcttgtgcagcctctggattcacctttagcagctatgccatgagctgggtccgccaggctccagggaaggggctggagtgggtctcagttattggtgggagtggtggttctacatcctatacagactccgtgaagggccggttcatcatctccagagacaatttgaagaacacgctgtttctgcaaatgaacagcctgagagtcgaggatacggccgtatactactgtgcgagaaggcagggctacagtagttcgtccccgttgaaatactggggccagggaatcctggtcaccgtcgcctcag

SEQ ID NO: 2906 - DNA, 373 bp, Artificial Sequence
  Synthetic construct
gaggtgcagctggtggagactggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagacttttggggttactatggttcggggattagaaaagagtttgatatctggggccaagggacaatggtcaccgtctcttcag

SEQ ID NO: 2907 - DNA, 373 bp, Artificial Sequence
  Synthetic construct
gaggtgcagctggtggagactggaggaggcttgatccagcctggggggtccctgagactctcctgtgcagcctctgggttcaccgtcggtagcaactacatgagctgggtccgccaggctccagggaaggggctggagtgggtctcagttatttatagcggtggtagcacatactacgcagactccgtgaagggccgattcaccatctccagagacagttccaagaacacgctgtatcttcaaatgaacagcctgagagccgaggacacggccgtgtattactgtgcgagtcgaggaattaacggggggttcggggaagatgaggaatacttccaccactggggccagggcaccctggtcaccgtctcctctg

SEQ ID NO: 2908 - DNA, 364 bp, Artificial Sequence; identical to SEQ ID NO: 1765
  Synthetic construct

SEQ ID NO: 2909 - DNA, 382 bp, Artificial Sequence
  Synthetic construct
gaggtgcagctggtggaatctgggggaggcttggtccagcctggggggtccctgagactctcctgtgcagcctctggattcacctttagtacccattggatgagctgggtccgccaggctccagggaaggggctggagtgggtggccaacataaagcaagacggaagtgagaaatactatgtggactctgtgaagggccgattcaccatctccagagacaacgccaagaactcactgtatctgcaaatgaacagcctgagagccgaggacacggctgtgtatttctgtgcgagagatgggtcttgtgattacatttgggggggttatcgttatgatgcttttgatatttggggccaagggacaatggtcaccgtctcctcag

SEQ ID NO: 2910 - DNA, 373 bp, Artificial Sequence
  Synthetic construct
gaggtgcagctggtggagtctgggggaggcttggtccagcccggggggtccctgagactctcttgtgcagcctctggattcacctttagtgactattggatgagctgggtccgccaggctccagggaaggggctggagtgggtggccaacataaagcaagatggcagtgagaaatacttggtggactctgtgaagggccgattcaccatctccagagacaacgccaagaactcactgtatctgcaaatgaacagcctgagagccgaggacacggctgtgtattactgtgcgagccatccttatgggaggtatagcagtggctggggggcctttgactactggggccagggaaccctggtcaccgtctcctcag

SEQ ID NO: 2911 - DNA, 381 bp, Artificial Sequence
  Synthetic construct
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagacagcgaagcgagtggatagtagtggttattacgggctactactacatggacgtctggggcaaagggaccacggtcaccgtctcctca

SEQ ID NO: 2912 - DNA, 388 bp, Artificial Sequence
  Synthetic construct
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagatcgcggacaccccaattactatggttcggggagttattaccgctactactttgactactggggccagggaaccctggtcaccgtctcctcag

SEQ ID NO: 2913 - DNA, 355 bp, Artificial Sequence
  Synthetic construct
gaggtgcagctggtggagtctgggggaggcttggtccagtctggggagtccctgagagtctcctgtgcagcctctggattcacctttagtttctattggatgagctgggtccgccaggctccagggaaggggctggagtgggtggccaacataaagaaagatggaagtgagaaattctatgtggactctgtgaagggccgattcaccatctccagagacaacgccaagaaatcactgtatctgcaaatgaacagcctgagagccgaggacacggctgtgtattattgtgcgcgacggtcgtatagtggctactttgactcctggggccagggaaccctggtcaccgtctcctcag

SEQ ID NO: 2914 - DNA, 346 bp, Artificial Sequence
  Synthetic construct
gagttgcgactggtggagtctgggggaggccgggtccagccgggggggtccctgagactctcctgtgcagcctctggactcccccttggttggatgagctgggtccgccaggctccagggaaggggctggagtgggtggccttcataagcgacgacggatttcaaaaagcatatgtggactcgctgaagggccgattcatcatctccagagacaacgcccagaactcactgtttctgcaaatgaacagcctgacagtcgaggacacggctgtctattactgtgcgaccctgaagtggaattccttagactcctgggggcagggagtcctggtcaccgtctcctcag

SEQ ID NO: 2915 - DNA, 379 bp, Artificial Sequence
  Synthetic construct
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagggttcgattttggagtggttattattgtcgatggcatggacgtctggggcaaagggaccacggtcaccgtctcctcag

SEQ ID NO: 2916 - DNA, 390 bp, Artificial Sequence
  Synthetic construct
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagtcccttattgtagtggtggtagctgctacggggactactactactacatggacgtctggggcaaagggaccacggtcaccgtctcctca

SEQ ID NO: 2917 - DNA, 382 bp, Artificial Sequence
  Synthetic construct
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacctcaatcgaattactatggttcggggagcccctcggcgcttttgatatctggggccaagggacaatggtcaccgtctcttcag

SEQ ID NO: 2918 - DNA, 372 bp, Artificial Sequence
  Synthetic construct
gaggtgcagctggtggagtctgggggaggcttggtaaagcctggggggtcccttagactctcctgtgcagcctctggattcactttcagtaaggcctggatgagctgggtccgccaggctccagggaaggggctggagtgggttggccgtattacaaccaattctgatggtgggacaacagactacgctgcacccgtgaacggcagattcatcatctcaagagaagattcaaaaaacacactgtatctgcaaatgaacagcctgaaaaccgaggacacagccgtgtattactgtaccactttacggtcaggggactactacttctactacatggacgtctggggcaaagggaccacggtcaccgtctcctca

SEQ ID NO: 2919 - DNA, 370 bp, Artificial Sequence
  Synthetic construct
gaggtgcagctggtggagtttgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatgatgggacaacagactacgctgcacccgtgaaaggcagattcaccatctcaagagatgattcaaaaaactcgctgtatctgcaaatgaacagcctgaaaaccgaggactcagccgtgtattactgtaccacagagggcggcagtggctggtttgggtactttgactactggggccagggaaccctggtcaccgtctcctcag

SEQ ID NO: 2920 - DNA, 352 bp, Artificial Sequence
  Synthetic construct
gaggtgcaactggtggagtctgggggaggcttggtacagccagggcggtccctgagactctcctgtacagtctctggtttcaaattcggtgattatgctatgagctgggtccgccaggctccagggaagggtctggagtgggtaggtctcattagaagcaaagcttttggtgggaccacagaatacgccgcgtctgtgagaggcagattcaccatctcaagagatgatggcaaaagcatcgcctatctgcaaatgaacaacctgcgaaccgaggacacagccgtgtattactgtagtagagactggggcattgcactctggggccaagggacattggtcaccgtctcttcag

SEQ ID NO: 2921 - DNA, 382 bp, Artificial Sequence
  Synthetic construct
gaggtgcagctgttggagtctgggggaggcttggtacagccgggggggtccctgagactctcctgttcagcctctggattcacctttagcacctatggcatgagctgggtccgccaggctccagggacggggctggagtgggtctcagctattagtggtagtggtgatagcacatactacgcagactccgtgaagggccggttcaccatctccagagacaattccaagtacacgctgtatctacaaatgaacagcctgagagccgaggacacggccgtatattactgtgcgaaagatgggggaagaacgtcttactatgatactagtgcttattactactttgactactggggccagggaaccctggtcaccgtctcctcag

SEQ ID NO: 2922 - DNA, 385 bp, Artificial Sequence
  Synthetic construct
gaggtgcagctggtggagtctgggggaggcttggtccagcctggggggtccctgagactctcttgtgcagcctctggattcacctttagtagctattggatgagctgggtccgccaggctccaggtaaggggctggagtgggtggccaacataaagcaagatgggagtgacaaatactatgtggactctgtgaagggccgattcaccatctccagagacaacgccaagaactcactgtatctgcaaattaacagcctgagagccgaggacacggctgtgtattcctgtgcgagagaagatcgtggatattgtagtagtggtagctgctactttgtagggacctttgactactggggccagggaaccctggtcaccgtctcctcag

SEQ ID NO: 2923 - DNA, 349 bp, Artificial Sequence
  Synthetic construct
gaggtgcagttggtggagtctgggggagacttggtccagcctggggggtccctgagactctcctgtgcagcctccggattccactttagtagttattggatgagctgggtccgcctgactccagggaagtggctggagtgggtggccaccataaaccaagatggaagtgagcgaatctatgtggactctgtgaagggccggttcaccatctccagagacaacgccaagaactctctgtttctgcaaatggacagcctgagaggcgaagacactggtctttattactgtgcgcgagggtcccgggaggttctctactggggccagggagccctggtcaccgtctcctcag

SEQ ID NO: 2924 - DNA, 373 bp, Artificial Sequence
  Synthetic construct
gaggtgcagttggtggagaccggaggagagttgatccagcctggggggtccctgagactctcctgtgcggcctctgggctcaccgtcaccagaacctacatgagctgggtccgcctggctccagggaagggcctggagtgggtctcagttatctatatcggtgatagagcatactacgcagagtccgtgaagggccgattcaccatctctcgagacaattccaagaacactttgtatcttcaaatgaacagcctgagagtcgacgacacggccgtctattactgtgcgagaggaggggcccattattgtggtggtgactgcccgagggcttttgacatctggggccaggggacaatggtcatcgtctcttcag

SEQ ID NO: 2925 - DNA, 355 bp, Artificial Sequence
  Synthetic construct
gaggtgaagttggcggagtctgggggaggcttggtccagcccggggggtccctgacactctcctgtgtagtctctggtttcacatttgggcactattggatgagctgggtccggcaggctccagggaagggactggagtgggtggccaacatcaagttcgatggaagtgaaaaaaattatgtggactctgtgaagggccgattcaccatctccagagacaacgcccagaattcagtgtttctgcaaatgaggcgcctgagagtcgaggacacggctgtctactattgtgcgagtctctggtcccgttactactttgacttctggggccagggagccctggtcaccgtctcctcac

SEQ ID NO: 2926 - DNA, 364 bp, Artificial Sequence
  Synthetic construct
caggtgcagctggtggaatctgggggaggcttggtcaagcctggagggtccctgagactctcctgtgcagcctctggattcaccttcagtgattactacatgagttggatccgccaggctccagggaaggggctggagtgggtttcagatgttagtagtggtggcagtacaaaatactacgcagactctgtgaggggccgattcaccgtgtccagggaccaggccaaaaactcactgtttttgcaaatgaacagtctgagagtcgaggacacggctgtatattactgtgcgagagcgacgggtgggaccttctactaccatatggacgtctggggcaaagggaccacggtcaccgtctcctcag

SEQ ID NO: 2927 - DNA, 402 bp, Artificial Sequence
  Synthetic construct
gaggtacaactagtggagtctgggggacgtgtggtacggccgggggagtccctgagactctcctgtgcagtctctgggttcacttttgatgatcatgcaatgagttgggtccgccaagttccagggagggggctggagtgggtctctggcattaatggcgatggcacaagtgcaacttatgcagactctgtgaagggccgattcaccatcgccagggacaacgccaggaactccctctacctgcaaatgaatggtctgggacccgacgacacggccctttatttctgtgtaaaacaggctctgaatactgggtacgattcgactttttcaccctttgtctctatctactactacttctacatggacgtctggggccgagggaccaccgtcaccgtctcctca

SEQ ID NO: 2928 - DNA, 370 bp, Artificial Sequence
  Synthetic construct
ggggtgcatctggtggagtctgggggaggcttggtccagcctggggggtccctgagactctcatgtgcagcctctggattcacctttagttcctactggatgagttgggtccgccaggctccaggcaaggggctggagtgggtggccaatataaaatatgatggcagtgagaaatacgggttgggctctgtggggggccgattcaccatctccagagacaacgccaagaactcactgtatctccaaatgaacagcctgagagccgaggacacggctgtgtattactgtgggagactctgccaggcgttttggtccggggaacattgtggggactcctggggccagggaaccctggtcaccgtctcctcag

SEQ ID NO: 2929 - DNA, 379 bp, Artificial Sequence
  Synthetic construct
gaggtgcagttggtggagtcggggggagacttggtccaccctggagggtccctgagactctcctgtgaagcctctggattcaccttcagtagttctgagatgagttgggtccgccaggctccagggaaggggctagagtgggtttcatatatcactactcaaggctctaccatatcctacgcagagtctgtgaagggccgattcaccgtctccagagacaacgccaggaactcactgtatctgcacatgaatagcctgagagccgaggacacgggtgtttattattgtgcgacacacgtctcgctccattgtggttctaattgctattcggaatatttccatcactggggccagggcaccctggtcatcgtctcctcag

SEQ ID NO: 2930 - DNA, 361 bp, Artificial Sequence
  Synthetic construct
gaggtgcagctggtggaatcggggggaggcttggtacagccagggcggtccctgagactctcctgttcagcttccggattcacctttggtgactacactatgagttgggtccgccaggctccagggaaggggctggagtgggtaggtttcattagaagcaaagcttatggtgggacaacagaatacgccgcgtctctgaaaggcagattcaccatctcaagagatgattccagaagcatcgcctatctgcaaatgaacagcctgaaaatcgaggacacagccgtgtattactgtatttcggctgctacggatgagctctttgagtactggggcccgggaaccctggtcaccgtctcctcag

SEQ ID NO: 2931 - DNA, 373 bp, Artificial Sequence
  Synthetic construct
gaggtgcagctgttggagtctgggggaggcttggtacagcctggggggtccctgagactctcctgtgtagcctctggattcacctttaatatctttgccatgagttgggtccgccaggctccagggaaggggctggagtgggtctcaacgattagtggtagtggtgccccactctactcagactccgtgaagggccggttcaccatctccagagacaattccaaaaacacactgtatctgcaaatcaacagcctgagagccgaagacacggccatatatcactgttcaaagaatcagtttgatagtagtggttattacttaggaggggcttttgatatctggggccaagggacaacggtcaccgtctcttcag

SEQ ID NO: 2932 - DNA, 376 bp, Artificial Sequence
  Synthetic construct
gaggtgcagttgttggagtctgggggaggcttggtacggcctggggggtccctgagactctcctgtgcagcctctggattcacctttagaatctttgccatgagttgggtccgccaggctccagggaaggggctggagtgggtctcagctgttagtgctagtggtggtaacacatactacgcagactccgtgaagggccgtttcaccatctccagagacaattccaagaacacggtgtatctggaaatgaacagcctgaaagccgaggacacggccgtatattactgtgcgaaaaccacgacgttttattatgataatagtgacctttttgcttttgatatctggggccaagggacaaaggtcaccgtctcttcag

SEQ ID NO: 2933 - DNA, 367 bp, Artificial Sequence
  Synthetic construct
gaggtgcaactggtggagtctgggggaggcttggtccagcctggggggtccctgagactctcttgtgcagcctctggattcacctttagtagttattggatgagttgggtccgccaggctccagggaaggggctggagtgggtggccaatataaagcaagatggaagtgagaaaaactatgtggactctgtgaagggccgattcatcatctccagagacaatgccaagaactcagtgtatctgcaaatgaacagcctgagagtcgaggacacggctatctattattgtgcgagagaggcaggtggctggtcctctcacaactggttcgacccctggggccagggaaccctggccaccgtctcctcag

SEQ ID NO: 2934 - DNA, 355 bp, Artificial Sequence
  Synthetic construct
gaggtgcagctggtggagtctgggggaggcttggtccagcctggggggtccctgagactctcctgtgcagcctctggattcacctttagtggctattggatgagttgggtccgccaggctccagggaaggggctggagtgggtggccaatataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaagggcattccgaaggttttgatatttggggccaagggacaaaggtcaccgtctcttcag

SEQ ID NO: 2935 - DNA, 391 bp, Artificial Sequence
  Synthetic construct
gaggtgcaactggtggagtctgggggaggcttggtaaagcctggggggtcccttagactctcctgtgcagcctctgcattcactttcagtaaggcctggatgagttgggtccgccaggctccagggaaggggctggagtgggttggccgtattaaaagcaacactgatggtgagacaacagactacgctgcacccgtgaaaggcagattcaccatctcaagagatgattcaaaaaacacgctgtatctgcaaatgaacagcctgaaaaccgaggacacagccgtgtattactgtaccacaggactaggaagcgatgataatagtgattattttatgaacattgatggttttaatatctggggccaagggacaaaggtcaccgtctcttcag

SEQ ID NO: 2936 - DNA, 373 bp, Artificial Sequence
  Synthetic construct
gaggtgcaactggtggagtctgggggaggcttggtccagccgggggggtccctgagactttcctgtgcagcctctggattcacttttagtagatattggatgagttgggtccgccaggctccggggaaggggctggagtgggtggccaacataagatttgatgcgactgacacgaattatgtggcctctgtggagggcagattcaccatctccagagacgacagcaagaggtctgtagatttgcagatggacaggctgacagccgaagacacggccatctatttctgtgcgagagtttttaggactggagactattggaggggacttctgtgggactactggggccagggagcccaggtcaccgtctcctcag

SEQ ID NO: 2937 - DNA, 403 bp, Artificial Sequence
  Synthetic construct
gaggtggaactggtggagtctgggggaggcttggtccagcctggggggtccctaagactctcctgtgaagcctctggattcaccttcagtaattattggatgagttgggtccgccagtctccaggaaaggggctggagtgggtggccaacataaaaaaagatggaagtgagaaacattatgtcgactctgtgaagggtcgattcaccatctccagagacaacaccaacagttcattgtttctgcaaatgagtaggctgagagtcgaggacacggctgtttattactgcgcggctcatctgaggggggcgacagatggcggtttttggagtggccttgcgcgtttgaagtcctgggggtggctcgacccctggggccagggagcccaagtcaccgtctcctcag

SEQ ID NO: 2938 - DNA, 379 bp, Artificial Sequence
  Synthetic construct
gaggtgaggctggtggagtctgggggaggcttggttagacctggggaatctctcagaataacatgtgcagcctctggattcattttcaaaaatgcctggatgagttgggtccgccagtctccagggagggggctggagtgggttggccgaattaagacgaaggaagatggtgggacaacagactacgccgcacccgtgagaggcagattcaccatttcaagacatgattcattagacacactgtctctacaaatgaacaacgtgacagccgacgacgcagccgtctattactgtaccacagattttcggttcgatgacagtggttactacaactacttagataactggggacagggaacccgcgtcaccgtctcctcag

SEQ ID NO: 2939 - DNA, 373 bp, Artificial Sequence
  Synthetic construct
gaggtgatgttggtggagtctgggggaggcgtggtacagccgggggggtcattgagtcttacctgtgtggcctccggattcacttttaattcttattccatgagttgggtccggcaggctccaggaaagggactagagtgggtcgcatatattagcgccagcggcggtaccacatattatacagactccgtgaagggccgcttcaccatctccagagacagctccaagaacatccttcatctccaattggacagtctgaaagtcgaggactcggccctttattattgtgcgaaagagggtggacgtggatatagttccttcgataattactttgactattggggccagggagccctggtcaccgtcgcctcag

SEQ ID NO: 2940 - DNA, 352 bp, Artificial Sequence
  Synthetic construct
caggtccagttggtgcagtctggggctgaggtgaagaagcctgggtcctcggtgaaggtctcctgtaagatttctggagacaccttctttaactatgttatgatatgggtgcgacaggcccctggagaagggcttgagtggatgggagggaccatccccatttctggcacagcaaagtatgcacagaagttccagggcagagtcacgatcaccacggacgaatccacaaggacagtctacatggaactgagtagcctgacatctgacgacacggccgtttattattgtgcgagaaatagtgcccagccctttgactcctggggccagggaaccctggtcaccgtctccacgg

SEQ ID NO: 2941 - DNA, 385 bp, Artificial Sequence
  Synthetic construct
caggtgcagctggtggagtctgggggaggcttggtcaaacctggagggtccctgagactctcctgtgcagcctctggattcaccttcagtgactactacatgatctggatccgccaggctccagggaaggggctggagtggatttcattcattagtagcagtggtagtggcatatactacgcagactccgtgaagggccgattcaccgtctccagggacaacgccaagaagtcactgtatctgcaaatgaacagcctgagagccgaggacacggctgtgtattactgtgcgagagatatcgcccctcattactatgatagtagtgcttattcacccgatgcttttgatatctggggccaagggacaatggtcaccgtctcttcag

SEQ ID NO: 2942 - DNA, 364 bp, Artificial Sequence
  Synthetic construct
gaggtgcagctggtggagtctgggggagacttggtacagcggggggggtccttgagactctcctgtgcagcctctggattcacctttaacaattatggcatgatctgggtccgccagcctccagggaaggggctggagtgggtctcatctatcagtagtggtggtggtaggacatactatgcagactccgtgaagggccggttcaccatctccagagacaattccaagaacacggtgtatctacaaatgaatagcctgagagtcgaggacacggccgtatattattgtgcgaaacggcaggggtatagtagctcgtccccgttggggtcctggggccagggaaccctggtcaccgtctcctcag

SEQ ID NO: 2943 - DNA, 364 bp, Artificial Sequence
  Synthetic construct
gaggtgcagctggtggagtctgggggagacttggtacagcggggggggtccttgagactctcctgtgcagcctctggattcacctttaacaattatgccatgatctgggtccgccaggctccagggaaggggctggagtgggtctcatctatcagtagtggtggtggtaggacatactatgcagactccgtgaagggccggttcaccatctccagagacaattccaagaacatggtgtatctacaaatgaatagcctgagagtcgaggacacggccgtatattattgtgcgaaacgacaggggtatagtagctcgtccccgttggggtcctggggccagggaaccctggtcaccgtctcctcag

SEQ ID NO: 2944 - DNA, 373 bp, Artificial Sequence
  Synthetic construct
gaggtgcagctggtggagtctgggggaggcttgatagagcctggagggtccctgagactctcttgtgtagcctctggatttaccttcagtctctatgaaatgatctgggtccgccaggctccagggaaggggctggagtgggttgcatatgtttctactaggggtgataccacatactatgctgactctctgaggggccgattcaccatctccagagacaactccaagaatttactctctctacaaatgaacagcctgcgagccgaggacacggctctttatttctgcgcgagagtcggctgtagtggtgatcattgctatggatattactttgactactggggacagggaaccctggtcgccgtctcctccg

SEQ ID NO: 2945 - DNA, 355 bp, Artificial Sequence
  Synthetic construct
gaggtccagctgctacagtccggggctgaggtgaagaagcctggggccaccgtgaaaatctcctgcaaggcttctggatacaccttcaccgactactacatgcactggattcaacaggcccctggaaaagggcttgagtggttgggacgtgtggatcctgaagatggcaaaactgtttatgcagaccttttgtatggcagagtcaccatgaccgcggacgcgtcgacagacacagcctacctggagctgagcggcctgacatctgaagacacggccctttatttctgtgcaaccctctctgcccctgttatctcccgtcactggggccagggaacccaggtcaccgtctcctcgg

SEQ ID NO: 2946 - DNA, 367 bp, Artificial Sequence
  Synthetic construct
caggaacaactggtggagtctgggggaggcgtggtgcagcctgggatgtccctgagactttcctgtgcagcctctggattcatcttcagtgactatggcatgcactgggcccgccaggctccagacaagggcctggagtgggtggcgattatttcacacgatggaaatagtaaatattatgcagactctgtgaagggccgactcaccatttccagagacaactccaagaaaacagtctttttgcaaatgaatagcctgagaaatgaggacacaggtatatattattgtgcgagagggcgcagtgactggttgactggaggaggttttgatatttggggccgggggacagtggtcaccgtctcctcag

SEQ ID NO: 2947 - DNA, 358 bp, Artificial Sequence
  Synthetic construct
gaggtgcagctggtggagtccgggggaggcttagttcagcctggggggtccctgagactctcctgtgcagcctctggattcaccttcagttactactggatgcactgggtccgccaagctccagggaagggactggtgtgggtctcacgtattaatagtgatggaaataatacacgctacgcggactccgtgaagggccgattcaccatctccagagacaacgccaagaacacactgtatctgcaaatgaacagtctgagagccgaggacacggctgtatattactgtgcaagagaggactacggtggtaaaccccaggcctactggggccagggaaccctggtcaccgtctcctcag

SEQ ID NO: 2948 - DNA, 355 bp, Artificial Sequence
  Synthetic construct
gaggtgcagctggtggagtctgggggcggcctggtcaagccgggggggtcccttagactctcctgtgcagtgtcagggttcaccttcagtgactacaccatgcactgggtccgccactctccagggaagggactggagtgggtctcatccattagtagtggtgatgtcttcatcaactacgcagactcagtgaagggccgattcagcacctccagagacaacgccaagaactccctatatctgcaaatgagtagcctgagagtcgaagacacggctgtctattactgtgcgagaggtttgtccgcagtggctggttcggggtggggccagggaaccctggtcaccgtctcctcag

SEQ ID NO: 2949 - DNA, 370 bp, Artificial Sequence
  Synthetic construct
gaggtgaacctggtggagtctgggggaggcttggcccagccgggggggtccctgagactctcctgtgcagcctctggattcaccttcagtagctatgctatgcactgggtccgccagcctccagggaagggactgcaatttgtttcaagtattactaattctggggctggcacatattatgcagactccgtgaagggcagattcaccatctccagagacaacgccaggaacacggtgtatcttcagatgggcagcctgagacctgaggacacggctttatattactgtgcgcgagttcagcatgatagtagtggttattattctggccttgacttctggggccagggaaccctggtcaccgtctcctctg

SEQ ID NO: 2950 - DNA, 375 bp, Artificial Sequence
  Synthetic construct
caggtgcagctggtggagtcggggggaggcgtggtccagcctgggaggtccctgagactctcctgtgcagcctctggattcaccttcagcgattatggcatgcactgggtccgccaggcgccaggcaaggggctggagtgggtggcaggtgtctcatatgatggagacaataaatactacgcagactccgtgaagggccgagttaccatctccagagacaattccgaggacaccctatatctccacatgaatagcctgagaatccaggacacggctgtttatcactgtgcgaggcgatacaccggtgcctggtcctacttcacgtaccactacttggacgtctggggcaaggggaccgcggtcacggtctcctca

SEQ ID NO: 2951 - DNA, 373 bp, Artificial Sequence
  Synthetic construct
caggtgcagctggtggagtctgggggaggcgtggtccagcctgggaggtccctgagactctcctgtgcagcctctggattcaccttcagtagttatggcatgcactgggtccgccaggctccaggcaagggactggagtgggtggcagttatctcttatgatggaattaataaatactttgcagactccgtgaagggccgatgcaccatctccagagacaattccaagaacacgctgtatctgcaaatgaacagcctgagagctgaggacacggctgtgtattactgtgcgaaaccgcgggtgaactttggttcggggagaggagacgattttgatatctggggccaagggacaatggtcaccgtctcttcag

SEQ ID NO: 2952 - DNA, 282 bp, Artificial Sequence
  Synthetic construct
gggggagttcggccatgcactgggtccgccaggctccaggcaagggcctggagtggctggcacttgtgtcatttgatggaaacaaaaaaaggtatgcagactccgtgaagggccgattcaccgtctccagagacaattccaagaacacgctgtttctgcaaatggacagcctgagaccggaggacacggctgtgtacttctgtgcgagaaattttggagtgattcttataggagatgcctttgatctctggggccaagggacaatggtcaccgtctcttcag

SEQ ID NO: 2953 - DNA, 379 bp, Artificial Sequence
  Synthetic construct
caggtgaagctggtggagtctgggggaggcgtggtccagcctgggaggtccctgagactctcctgtgcagcctctggattcaccttcagcaaccatggcatgcactgggtccgccaggctccaggcaaggggctgcaatggctgggagttatatcatataatggaagcagacaatattacgcagactccgtgaggggccgattcaccatctccagagacaactccaagaacacattatttctgcaaatgatcaggctgagacttgaggacacctctgtttattattgtgtcagaggcgattcagttcacttcgataggaatgcatattatgggggatttgatgtctggggccaaggggcactggtcaccgtctcctcag

SEQ ID NO: 2954 - DNA, 370 bp, Artificial Sequence
  Synthetic construct
caggtgcggatggtgcagccgggaggaggcgtggtccagcctggggggtccctgacactctcctgtgatgtctctgcattcaccttcaatgcctacggcatgcactgggtccgccaggctccaggcaaggggctggaatggctggcagttatatcaaatgatggaaccaaaacatactacgcagactccgtgaggggccgattcatcatttccagagacaattccaagaacacgctgtatctgcaaatgaacagcctgaaacctgaggacacggctgtgtattactgtgcgagagatccccctagtgagtgggaggtaacgttctactttgactactggggccagggaaccctggtcaccgtcacctcag

SEQ ID NO: 2955 - DNA, 375 bp, Artificial Sequence
  Synthetic construct
caggtgcagctggtggagtctgggggaaccgtggtccagcctgggacatccctgagactctcctgtgcagcctctggattctccttcagtagttatggcatgcactgggtccgccaggctccaggcaaggggctggaatgggtggcagttatatcaaatgacagaaataagaactattacgcagactccgtgaagggccgattcaccatctccagagacaattccaagaacacgctgtatttgcaaatgaacagcctgagacctgacgacacggctgtgtattactgtgcgagagacggtgcgtccatttttatcgaagtaattaatttctacatggacgtctggggcaaagggaccacggtcaccgtctcctca

SEQ ID NO: 2956 - DNA, 367 bp, Artificial Sequence
  Synthetic construct
caggtgcagctggtggagtctgggggaggcgtggtccagcctgggaggtccctgagactctcctgtgcagcctctggattcaccttcagtagctatggcatgcactgggtccgccaggctccaggcaaggggctggagtggctggcacttatatcatatgatggaacctataaatactacgcagactccgtgaagggccgattcaccatctccagagacgattccaagaacaccctgtatctgcaaatgaacagcctgagaactgaggacacggctgtgtattactgtgcgcgccggttttgtagtggtggtagctgctactctcttgaatattggggccagggaaccctggtcaccgtctcctcag

SEQ ID NO: 2957 - DNA, 367 bp, Artificial Sequence
  Synthetic construct
caggtgcagttggtggagtctgggggaggcgtggtccagcctgggaggtccctgcgactctcctgtgcagcgtctggattcaccttcagcacctatgccatgcactgggtccgccaggctccaggcaaggggctggagtggctggcagtcctttggtatgatggaagtaataaacagtatggagagaccgttaagggccgattcaccatctccagagacaatcccaagaacacactatatctgcaaatgaacagcctgagagtcgacgacacggctgtatattattgtgtgaaggattcgggttcggggaggatcatttccctgcttgacttctggggccagggaaccgtggtcaccgtctcttcag

SEQ ID NO: 2958 - DNA, 364 bp, Artificial Sequence
  Synthetic construct
caggtgcagctggtggagtctgggggaggcgtggtccagcctgggaggtccctgagactctcctgtgcagcctctggattcgtcttcagtagttatggcatgcactgggtccgccaggctccaggcaaggggctggagtggctggcagttatatcatttgatggaaacactgagcgctacgcagactccgtgaagggccgattcaccatctccagagacaactccaagaacacgctgtctctgcagatgaacagcctgagagctgacgactcggctgtatatttctgtgcgagaggtcccggatacagctatgacatccagtttgactactggggccagggaaccctggtcaccgtctcctcag

SEQ ID NO: 2959 - DNA, 364 bp, Artificial Sequence
  Synthetic construct
caggtgcacctggtggagtctgggggaggcgtggtccagcctgggaggtccctgagactctcctgtgcagcctcgggattcaccttcagtagttatggcatgcactgggtccgccaggctccaggcaaggggctggagtgggtgacagttatctcatatgatgcaagtactgaattctacgcagactccgtgaagggccgattcatcatctccagagacaactccaagaacacgctgtatctggaaatgaacagcctgagagctgaggacacggctgtgtattactgtgcgagaagtcacggagatggctacaattcttactttgactactggggccggggaaccctggtcaccgtctcctcag

SEQ ID NO: 2960 - DNA, 361 bp, Artificial Sequence
  Synthetic construct
caggtgcagttggtggagtctgggggaggcgtggtccagcctgggaggtccctgagactctcctgtgcagcctctggattcaccttcagtagctatggcatgcactgggtccgccaggctccaggcaaggggctggagtgggtgacatttatatcatatgatggaagtaataaatactatgcagactccgtgaagggccgattcaccatctccagagacaattccaagaacacgctgtatctgcaaatgaatagcctgagagctgaggacacggctgtgtatttctgtgcgaaagactattatggttcggggagttattgcgactactggggccagggaaccctggtcaccgtctcctcag

SEQ ID NO: 2961 - DNA, 388 bp, Artificial Sequence
  Synthetic construct
caggtgcaactgatggagtctgggggaggcgtggtccagcctgggaggtccctgagactctcctgtgcagcctctggattcagtttcagtaactatggcatgcactgggtccgccaggctccaggcaaggggctggagtgggtggcaattatatcaaatgatgacagcatcaaatactacggagactccgtggagggccgattcaccatctccagagacaattccaagaatatgttgtatctgcaaatgaacagcctgagagctgaggacacggctgtgtatttctgtgcgagagccaacacctattactttacctcggggacttattataacaatgacgactaccttgactcctggggccagggaaccctggtcaccgtctcctcag

SEQ ID NO: 2962 - DNA, 364 bp, Artificial Sequence
  Synthetic construct
caggtgcggctggtggagtctgggggaggcgtggtccagcctgggaggtccctgagactctcctgtgcagcctctggattcaatttcacttcctatgccatgcactgggtccgccaggctccaggcaaggggctggagtgggtggcaattatatcctatgatgggggcaataaatattacgcagactccgtgaagggccgattcaccatctccagagacaattccaagagcacactgtatctgcaaatgaacagcctgagaactgaagacacggctatatattactgtggaagagattttgggagatggccgcccaggggacttgactactggggccagggaaccctggtccccgtctcctcag

SEQ ID NO: 2963 - DNA, 361 bp, Artificial Sequence
  Synthetic construct
caggtgcagttggtggagtctgggggaggcgtgctccagtctgggaggtccctgagactctcctgtgcagcctctggattcagcttcagaagctatggcatgcactgggtccgccaggctccaggcaaggggctggagtgggtggcacaaatttcaaatgatggaagtaatgaatactatacagactccgtgaagggccgattcaccatctccagagacaattccaagaacacgctgtatctacaaatgaacagcctgagaactgcggacacggccgtgtattactgtgcgaaagacatgtttgatattagtggtctcaatgactactggggccagggaaccgtggtcaccgtctcctcag

SEQ ID NO: 2964 - DNA, 364 bp, Artificial Sequence
  Synthetic construct
caggtgcagctggtggagtctgggggaggcgtggtccagcctgggaggtccctgagactctcctgtgcagcctctggattcaccttcagttgctatggcatgcactgggtccgccaggctccaggcaaggggctggagtgggtggcagtaatatggtatgatggcactaagaaatactatgcagactccgtgaggggccgattcagcatctccagagacaattccaaaaacacactgtatctccaaatgaacagcctgagagctgaggacacggctgtatattactgtgcgaaagatcgggatgactacggtgactactactttgactactggggccagggaaccctggtcaccgtctcctcag

SEQ ID NO: 2965 - DNA, 286 bp, Artificial Sequence
  Synthetic construct
accttcagtaactatggcatgcactgggtccgccaggctccaggcaaggggctggagtgggtggcagttatatcatatgatggaagcaataaatactacgcagactccgtgaagggccgattcaccatctccagagacaattccaagaacacactatatatgcaaatgaacagcctgagagctgaggacacggctgtctattactgtgcgagagcccaaacccattactatgatagtagagggtttggcgactggggccagggaaccctggtcaccgtctcctcag

SEQ ID NO: 2966 - DNA, 364 bp, Artificial Sequence
  Synthetic construct
caggtgcagctggtggagtctgggggaggcgtggtccagcctgaaaagtccctgagactctcgtgtgcaacgtctggattcaccttcagtagttatggcatgcactgggtccgccaggctccaggcaaggggctggagtgggtggcagttacatcagatgatggaagcagtaaatactacgcagaatccgtgaagggccgattcaccatctccagagacaattccaagaacactctctatctgcaaatgaacagcgtgaggcctgacgacacggctgtgtattactgtgcgagagatcggtttgtagaggctacgaccacggcggacttctggggccagggaaccctggtcaccgtctcctcag

SEQ ID NO: 2967 - DNA, 381 bp, Artificial Sequence
  Synthetic construct
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactatgcgagagtggagaggacaccctcatccggggcactctactactactactacatggacgtctggggcaaagggaccacggtcaccgtctcctca

SEQ ID NO: 2968 - DNA, 378 bp, Artificial Sequence
  Synthetic construct
caggtgcagctggtggagtctgggggaggcgtggtccagcctgggaggtccctgagactctcctgtgcagcctctggattcaccttcaatagctatggcatgcactgggtccgccaggctccaggcaaggggctggagtgggtggcagttatatggtatgatggaagtaatgaatactatgcagactccgtgaagggccgattcaccatctccagagacaattccaagaacacactgtatctgcaaatgaacagcctgagagctgaggacacggctgtgtattactgtgcgaaagagggtggatatagtggctacggttactactactactactacatggacgtctggggcaaagggaccacggtcaccgtctcctca

SEQ ID NO: 2969 - DNA, 364 bp, Artificial Sequence
  Synthetic construct
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatggtatgatggaagtaataaatactatgcagactccgtgaagggccgattcaccatttccagagacaattccaagaacacgctgtatctgcaaatgaacagcctgagagctgaggacacggctgtgtattactgtgcgaaagatccgaactcgggcagcagtggccaccttgactactggggccagggaaccctggtcaccgtctcctcag

SEQ ID NO: 2970 - DNA, 366 bp, Artificial Sequence
  Synthetic construct
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagctgaggacacggctgtgtattactgtgcgaaagatgtggttcggggagttgactactactacatggacgtctggggcaaagggaccacggtcaccgtctcctca

SEQ ID NO: 2971 - DNA, 382 bp, Artificial Sequence
  Synthetic construct
caggtgcagctggtggagtctgggggaggcgtggtccagcctgggaggtccctgagactctcctgtgcagcctctggattcaccttcagcaactatggcatgcactgggtccgccaggctccaggcaaggggctggagtgggtggcagttatatcatatgatggaagcaataaatactacgcagactccgtgaagggccgattcaccatctccagagacacttccaacaacacgctgtatctgcaaatgaacagcctgagagctgaggacacggctgtgtattactgtgcgagagatcggagtagttactatgatagtagtggttattacctaaactggttcgacccctggggccagggaaccctggtcaccgtctcctcag

SEQ ID NO: 2972 - DNA, 375 bp, Artificial Sequence
  Synthetic construct
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagattactgtagtagtaccagctgccctttctactactacatggacgtctggggcaaagggaccacggtcaccgtctcctca

SEQ ID NO: 2973 - DNA, 382 bp, Artificial Sequence
  Synthetic construct
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagcaataaatattatgcagactccgtgaagggccgattcaccatctccagagacaattccaagaacacgctgtatctgcaaatgaacagcctgagagctgaggacacggctgtgtataactgtgcgagagctcacggcgaaggatattgtactaatggtgtatgttcctcctactttgactactggggccagggaaccctggtcaccgtctcctcag

SEQ ID NO: 2974 - DNA, 355 bp, Artificial Sequence
  Synthetic construct
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaaagacgccaatggtggctggtatgactactggggccagggaaccctggtcaccgtctcctcag

SEQ ID NO: 2975 - DNA, 358 bp, Artificial Sequence
  Synthetic construct
ctggcgcagttggtggagtctgggggaggcgcggtcgagcctgggaagtcactaagactgtcctgtgcagcgtctggactcgccttcagaaattatgtcatgcactgggtccgccaggctccaggcaaggggctggagtgggtggcatatatatggaatgacggacagaagtcaaactacagagactccgtgaagggccgcttcaccgtttccagagacaattctaaggaaatgttgtttttacagatggattctatcagagccgacgacacggctatatattattgtgcgttctttccctcgggcagttatgcctttcacatttggggccgagggacagtggtcaccgtctccccag

SEQ ID NO: 2976 - DNA, 379 bp, Artificial Sequence
  Synthetic construct
caggtgcagctggtggagtctgggggaggcgtggtccagcctgggaggtccctgagactctcctgtgcagcctctggattcgccttcagtagctttggcatgcactgggtccgccaggctccaggcaaggggctggagtgggtggcatttatatcaaatgatggaagcaataaatactacgcagactccgtgaagggccgattcaccatctccagagacaactccaagaacacgctgtatctgcagatgaacagcctgagagctgaggacacggctgtcttttactgtgcaagggatcagtattactctgaaactactgcttattacttcaaatacttccaacactggggccagggcaccctggtcaccgtcacctccg

SEQ ID NO: 2977 - DNA, 378 bp, Artificial Sequence
  Synthetic construct
caggtgcaactggtggagtctgggggaggcgtggtccagcctgggaggtccctgagactctcctgtgcagcctctggattcctgttcagtagctatgccatgcactgggtccgccaggctccaggcaaggggctggagtgggtggccgttatatggtatgatggaagtaatcaacattatgcagactccgttaagggccgattcaccatctccagagacaattccgagaacacggtgtatctgcaaatgaacagcctgagagctgaggacacgggtgtatatttctgtgcgaaagtcggttatggtatcagttggtacttgggctactactactacatggacgactggggcaaggggaccacggtcaccgtctcctca

SEQ ID NO: 2978 - DNA, 378 bp, Artificial Sequence
  Synthetic construct
caggtgcaggtggtggagtctgggggaggcgtggtccagcctggggggtccctgagactctcctgtgaagcctctggattcaccttcgacagttatggcatgcactgggtccgccaggctccaggcaaggggctggagtgggtggcttttatatcacatgatggaaacaagaaattctatgcagactccgttaagggccgattcaccatctccagagacaattccaagaccacaatatatctacaaatcaacagcctgagtgccgaggacacggctatgttttactgtgcgagagctttcgggaatttttttgattggtcctcccgggactattacatggacgtctggggcgaagggaccgcggtcaccgtctcctca

SEQ ID NO: 2979 - DNA, 361 bp, Artificial Sequence
  Synthetic construct
caggtgcggcttttggagtctgggggaggcgtggtccagcctgggaagtccctgagactctcctgtgcagcctctggattcaccttcaccacctatgccatgcactgggtccgccaggctccaggcaaggggctggagtgggtgggagttgtatcacttgatggagacaaagaatactacgcagactccgtgaagggtcgatttacaatctctagagacaatttcaagaacacggtgtttctggaaatgaacaacctgagacctgaggaccaggctgtctattattgtgcgcgagggggggcctacgaaatgacctggtttgacacctggggccagggagccctggtcaccgtctcctcag

SEQ ID NO: 2980 - DNA, 375 bp, Artificial Sequence
  Synthetic construct
cagggacaactggtggagtctgggggaggcatggtccagcctggggggtccctgagactctcctgtgcagcctctggattcaccttcagtaactatgacatgcactgggtccgccaggctccaggcaaggggctggagtgggtgtcaattatatcatatgatggaaacaatgaaaactatgcagactccgtgaagggccgattcaccatctccagagacatttccgggaatacactgtatctgcaaatgaacagtctgagagttgaggacacggctgtttattactgtgcgcgagatcatatggtgtctgcttcctcctacaactccttctacatggacgtctggggcaaagggacgacggtcaccgtctcctca

SEQ ID NO: 2981 - DNA, 364 bp, Artificial Sequence
  Synthetic construct
caggtgcagctgctcgaatctgggggagccgtggtccagcctgggaggtccctgagactctcctgtgcagcctttggattccccctcagcaactacggcatgcactgggtccgccaggctccaggcaaggggctggagtgggtgtcatgtatatcagatgatggacaccataaatactacgcagattccgtgaagggccgattcaccatatccagagacaactctaaaaatacgatgtctctgcaaatgaacagtctgagaagtgaagatacggctttgtatttttgtgcgagcatgaccatggttcggacgaataactggttcgacctctggggccacggaaccctggtcaccgtctccgcag

SEQ ID NO: 2982 - DNA, 370 bp, Artificial Sequence
  Synthetic construct
caggtgcagttggtggagtctgggggaggcgtggtccagcctgggaggtccctgaggctcccctgtgcagcctctgggttcaccttcagtaaccatggcatgcactgggtccgccaggctccaggcaaggggctggagtggttatcacttatatcatatgatggaagccatgattactacgcagactccgtgaagggccgattcaccatctccagagacaattccaagaacacgttgtatctgcaaatgaacaacctgagagctgaggacacggctgtatattattgtgcgacagataggcattcctatcattcggggagttttgttcttgacttctggggccagggaaccctggtcaccgtctcctcag

SEQ ID NO: 2983 - DNA, 364 bp, Artificial Sequence
  Synthetic construct
caggtgcacctggtggagtccgggggaggcgtggtccagcctggggggtccctgagactctcctgtgtagcctctggtttcacctttggcgcctatgacatgcactgggtccgccaggctccaggcaggggtctggagtgggtggcaggtgtgtcatatgacgagagacagaaatcctttgcagactccgtgatggggcgatgcatcatctctagagacaattccgagaacaccctttttctgcaaatgcacagtctgagagttgaagatacggctctgtattactgcgcgaaaaagtttggccgcggactgtctgatgtttttgatatgtggggccaagggacaatggtcaccgtctcctcag

SEQ ID NO: 2984 - DNA, 349 bp, Artificial Sequence
  Synthetic construct
caggtgcagctggtggagtctgggggaggcgtggtccagcctgggaagtccctgagactctcctgtgcagcctctggattcaccttcagtaactatggcatgcactgggtccgccaggctccaggcgaggggctggagtgggtggcgtttatctcatatcatggaagtgataaacgttctgcagactccgtgaagggccgattcaccatttccagagacaattccaagaacacgctgtatctgcaaatgaacaacctgagacctgaagacacggctgtctattattgtgcgctatattggaattatgtcctcgagtggggccagggaaccctggtctccgtctcctcag

SEQ ID NO: 2985 - DNA, 373 bp, Artificial Sequence
  Synthetic construct
gaggtgcagctggtggagtccgggggaggcttggtccagcctggggggtccctgaaactctcctgtgcagcctctgggttcagcttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacatctggatttcaatagtgacccgtcggggggggactactggggccagggaaccctggtcaccgtctcctcag

SEQ ID NO: 2986 - DNA, 367 bp, Artificial Sequence
  Synthetic construct
gaagtgcagctggtggagtctgggggaggcttggtacagcctggcaggtccctgagactctcctgtgcagcctctggattcacctttgatgattatggcatgcactgggtccggcaaactccagggaagggcctggagtgggtcgcaggtattagttggaatagtgttaccataggctatgcggactctgtgaagggccgattcatcatctccagagacaacgccaagaactccctatatctgcaaatgaacagtctgagagctgaggacatggccgtgtattactgtgcaaaatccccctcccctgaggtgggaactacaccctttgactactggggccagggaaccctggtcaccgtctcctcag

SEQ ID NO: 2987 - DNA, 367 bp, Artificial Sequence
  Synthetic construct
gaagtgcagctggtggagtctgggggaggcttggtacagcctggcaggtccctgagactctcctgtgcagcctctggattcacctttgttgattttgccatgcactgggtccggcaagctccagggaaaggcctggagtgggtctcaggtattacttggaatagtggtagcacaggctatgcggactctgtgaagggccgcttcaccatctccagagacaacaccaagaactccctgtatctggaaatgaacagtctcagagttgaggacacggccttgtattactgtgcaaaggacctagcagcagctggcacttatgatgcttttgaaaaatggggccaagggacaatggtcaccgtctcttcac

SEQ ID NO: 2988 - DNA, 364 bp, Artificial Sequence
  Synthetic construct
gaagtgcagctggtggagtctgggggaggcttggtacagcctggcaggtccctgagactctcctgtgtagcctctggattcagtcttgatgattatgccatgcactgggtccggcaagctccagggaagggcctggagtgggtctcaggcattagttggaatagtggtagcgtagcctatgcggactctgtgaagggccgattcaccatctccagagaaaacgccaggaactccctgtatctgcaaatggacagtctgcgacctgaggacatggccttgtactactgtgtaaaagatctcgcgagcggtatggttcagggttttgatatctggggccaagggacaatggtcaccgtctcttcag

SEQ ID NO: 2989 - DNA, 376 bp, Artificial Sequence
  Synthetic construct
gaagtgcagctggtggagtctgggggaggctgggtacagcctggcaggtccctgagactctcctgtgcagcctctggattcacctttgatgattatgccatgcactgggtccggcaagctccagggaagggcctggagtgggtctcaggtattagttggaatagtggtagcgtaggctatgcggactctgtgaacggccgattcaccatctccagagacaacgccaagaactccctgtatctgcaaatgaacagtctgagagctgaggacatggccttgtattactgtgcaaaagattcccacccttcttatggttcggggagttgggatgcttttgatatctggggccaagggacaatggtcaccgtctcttcag

SEQ ID NO: 2990 - DNA, 373 bp, Artificial Sequence
  Synthetic construct
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtagaagcatagcctatgcggactctgtgaagggccgattcaccatctccagagacagcgccaagaactccctgtctctgcaaatgaacagtctgagagctgaggacatggccttgtattactgtgcaagagatataaacccctatagcagtggctgggtgtcctactttgactactggggccagggaaccctggtcaccgtctcctcag

SEQ ID NO: 2991 - DNA, 379 bp, Artificial Sequence
  Synthetic construct
gaagtgcagctggtggagtctgggggaggcttggtacatcctggcaggtccctgagactctcctgtgcagcctctggattcatctttgatgattatgccatgcactgggtccggcaagttccagggaagggcctggagtgggtctcaggtattagttggaatagtggtagcatagcctatgcggactctgtggagggccgattcaccatctccagagacaacgccaagaactccctgtatctgcaaatgaacagtctgagagctgaggacatggccttgtattactgtgcaaaggataggggattacgtttgggggagttatcgcggggtcactactttgacttgtggggccagggaaccctggtcaccgtctcctcag

SEQ ID NO: 2992 - DNA, 361 bp, Artificial Sequence
  Synthetic construct
gaggtgcacctggtggagtctgggggagtcgtggttcagcctggggggttcctgagactctcctgtgcagcctcgggattcacctttggtgattatgccatgcactgggtccgtcaggctccggggaaaggtctggaatgggtctctcttattaattgggatggtagtatcacgaactatgcagactctgtgaagggtcgattcaccatctccagagacaacagcaaaaacttcctgtatctgcaaatgaacagtctgagagctgaggacagcgccttgtattattgtgcaaaagacagtagtggatataatgatgcttttgagatctggggccaagggacaccggtcaccgtctcttcag

SEQ ID NO: 2993 - DNA, 361 bp, Artificial Sequence
  Synthetic construct
gaagtgcagctggtggagtctgggggagtcgtggtacaccctggggggtccctgagactctcctgtgtagcctctggattcacctttgatgattatgccatgcactgggtccgtcaggctccggggaagggtctggagtgggtctctcttattaattgggatggtagtagtacatcctatgcagactctgtgaagggtcggttcaccatctccagagacaactccaaaaactccctctttctgcaaatgaacagtctgagagctgaggacaccgccctgtattattgtgtgaaagataaaacccgtggccatcagtacttccaacactggggccagggcaccgtggtcaccgtctcctcag

SEQ ID NO: 2994 - DNA, 358 bp, Artificial Sequence
  Synthetic construct
gaggtgcagctggtggaatctgggggaatcgtggtacagccgggggggtccctgacactctcctgtgcagcctctggatttacttttaaagattttgccatgcactgggtccgtcgggtgccggggaagggtctggagtgggtctctgccattacttgggatggtggtcacacattctatggagactctgcgcagggtcgcttcagcgtctccagagacaacgacaaaaagttcctgtatctgcacatgaagagtctgagagctgaagacaccgccttcttttactgtgcaaaagatgagggatttttgactggtttttctcattggggccagggaaccctggtcaccgtctcctcag

SEQ ID NO: 2995 - DNA, 364 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaacaccctcgcgtagggggtggttattatgggttgactactggggccagggaaccctggtcaccgtctcctcag

SEQ ID NO: 2996 - DNA, 358 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaacagaaggatatagtggctacgactttgactactggggccagggaaccctggtcaccgtctcctcag

SEQ ID NO: 2997 - DNA, 346 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaacagatacccctattcgggagtggggccagggaaccctggtcaccgtctcctcag

SEQ ID NO: 2998 - DNA, 361 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaacagatcagggtagtggttattactactttgactactggggccagggaaccctggtcaccgtctcctcag

SEQ ID NO: 2999 - DNA, 358 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaacagccaacattggggctattactatagcctactggggccagggaaccctggtcaccgtctcctcag

SEQ ID NO: 3000 - DNA, 355 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaacagccgctagtagtggttattttttctactggggccagggaaccctggtcaccgtctcctcag

SEQ ID NO: 3001 - DNA, 382 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaacagcgggtggttacgatattttgactggttattatagccccggtgcttttgatatctggggccaagggacaatggtcaccgtctcttcag

SEQ ID NO: 3002 - DNA, 369 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaactgtaactactgggaggggctactactactactacatggacgtctggggcaaagggaccacggtcaccgtctcctca

SEQ ID NO: 3003 - DNA, 361 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaaggaggcattacgatattttgacttcggtcgacccctggggccagggaaccctggtcaccgtctcctcag

SEQ ID NO: 3004 - DNA, 358 bp, Artificial Sequence
  Synthetic construct
gaggtccagctggtacagtccggggctgaggtgaagaagcctggggccaccgtgaaaatctcctgcaaggcttctggatacaccttcaccgactactacatgcactgggtgcaacaggcccctggaaaagggcttgagtggatgggacgtgttgatcctgaagatggtgaaacaatatatgcagagaagttccagggcagagtcaccataaccgcagacacgtctacagacacagcctacatggagctgagcagcctgagatctgaggacacggccgtgtattactgtgcaatggttatggctacaatgaggagggttgactactggggccagggaaccctggtcaccgtctcctcag

SEQ ID NO: 3005 - DNA, 358 bp, Artificial Sequence
  Synthetic construct
gaggtccagctgttacagtccgagactgaggtgaagaagtctggggccaccgtaaaaatctcctgcaaggcttctggatacaccttcacctcctaccacatgcactgggtgcaacgggccccaggaagagggtttgagtggatgggacgtgttgatccagaagatggtgaaacaaaatatgcagacaggtttcggggcagagtcaccatgaccgcagacacgtctacaaatacagcctacatggagttgagcagcctgagattggaagacacggccgtctattactgtgcgacgcacttcgacggctacaatctacccgactactggggccagggaaccctagtctccgtctccccag

SEQ ID NO: 3006 - DNA, 355 bp, Artificial Sequence
  Synthetic construct
gaggtccacttgctccagtccggggctgaggtgaagaagcctggggccaccgtgaaaatctcctgcagggcttccggatacaccttcaccgactactacatgcactgggtgcatcaggcccctggcaaaggccttgagtggatgggacgtgttgatcctgaaaataatgaagcgatttatgcagaaaagttctatggcagcgtcaccatgaccgccgacacgtctacacaaacaacatttttggagttgagcagtctgaagtttgcggacacggccgtttattactgtgtgaccctctctgcccctgttacctcacgccagtggggccagggaaccctggtcaccgtctcctcgg

SEQ ID NO: 3007 - DNA, 376 bp, Artificial Sequence
  Synthetic construct
caggtgcagctggtgcagtctggggctgaggtgaagaagcctggggcctcagtgaaggtttcctgcgaggcatctggatacaccttcaccagctactatatgcactgggtgcgacaggcccctggacaaggacttgaatggatgggaataatcaaccctagtggtggtagcacatactacgcacagaagttccagggcagagtcaccatgaccagggacacgtccacgagcacagactatatggagatgagaagcctgagatctgaggacacggccgtgtattactgtgcgagagcctcaggtggatatagtggctacgaccaatggtactactttgactactggggccagggaaccctggtcaccgtctcctcag

SEQ ID NO: 3008 - DNA, 358 bp, Artificial Sequence
  Synthetic construct
caggtgcagctgctgcagtctggggctgaggtgaaggagcctggggcctcagtgaaagtctcctgcaaggcatctggatacaccttcaccaggtactatatgcactgggtgcgacaggcccctggacaaggccttgagtggatgggagtgatcagaccttctggtggtagcacaatctacgcacagaagctccaggacagagtctccctgaccagggacacgtccacgagcacaatgtacatggtactcaacagcctgagatctgaagacacggccgtctattattgtctgttactggaaggtttgacagcaacttctactgactggggccagggcaccctggtcaccgtctcctcag

SEQ ID NO: 3009 - DNA, 370 bp, Artificial Sequence
  Synthetic construct
caggtgcaactggtgcagtctggggctgaggtgaggaagcctggggcctcagtgaaagtttcctgcaaggcgtctggttacaccttcacttcctacttcatgcactgggtgcgacaggcccctggacaagggcctgagtgggtggctatgatcaaccctagtggtggtaccccaagttacgcacacaggttccggggccgagtcaccatgaccagtgacacgtccacgagcacagtttacctggagctgaccagcctgacacctgaggacacggccgtgtattactgtgcgagatgcgaaattttgaccggttattatagttgccacttcgactcctggggccagggaaccctggtcaccgtctcctcag

SEQ ID NO: 3010 - DNA, 372 bp, Artificial Sequence
  Synthetic construct
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagattgaatggtgactacgaagaggggaactactactacatggacgtctggggcaaagggaccacggtcaccgtctcctca

SEQ ID NO: 3011 - DNA, 358 bp, Artificial Sequence
  Synthetic construct
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaacctacgcacagaagttccagggcagagtcaccatgaccagggacacgtccacgagcacagtctacatggagctgagcagcctgagatctgaggacacggccgtgtattactgtgcgagtggggttgatacagcctatgcttttgatatctggggccaagggacaatggtcaccgtctcttcag

SEQ ID NO: 3012 - DNA, 376 bp, Artificial Sequence
  Synthetic construct
caggtgcaggtggtgcagtctggggctgaggtgaagaagcctggggcctcagtgaaggtttcctgcaaggcatctggatacatcttcaccagcttctttatgcactgggtgcgacaggcccctggacaagggcttgagtggatgggagtaatcaaccctaatagtggtagctcaacctacgcccagaagttccagggcagagtcaccatgaccagggacacgtccgcgagcacagtgtccatggagctgagcagcctgagatctgaggacacggccgtatattactgtgtgagagaaagggcccttcggcctaatatagcagctcgtggaccctttgactactggggccagggaaccctggtcaccgtctcatcag

SEQ ID NO: 3013 - DNA, 370 bp, Artificial Sequence
  Synthetic construct
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagataatcagttgaggagcagcacactatggggctttgactactggggccagggaaccctggtcaccgtctcctcag

SEQ ID NO: 3014 - DNA, 358 bp, Artificial Sequence
  Synthetic construct
caggtgcagctggtgcagtctggggctgaggtgaagaagcctggggcctcagtgaaggtctcctgcaaggcttctggatacaccttcaatgcctactatatgcactgggtgcgacaggcccctggacaagggcttgagtggatgggatggatcaaccctaacagtggtggcacctactatgcagagaagtttcggggcagggtcaccctgaccagggacacgtccatcagtacagtctacatggaggtgggcaggctgagatctgacgacacggccgtctattactgtgcggcggtcagggggagcttctttcaccttcaccactggggccagggaaccctggtcaccgtctcgtcag

SEQ ID NO: 3015 - DNA, 373 bp, Artificial Sequence
  Synthetic construct
caggtgcagctggtgcagtctggggctgaggtgaagaagcctggggcctcagtgaaggtctcctgtaaggcttctggatataccttcaccggctactatatgcactgggtgcgacaggcccctggacaagggcttgagtggatgggatggatcaaccctaacagtggtggcacaaactatggtcagaaatttcaaggcagggtcaccatgaccagggacacgtccttcagcacagtttacatggatctgagcaggctgacatctgacgacacggccgtgtattactgtgtgagagatctctggtcgatctacggtgacttcatcaagggatttgtcgactggggccagggaaccctggtcaccgtctcctcag

SEQ ID NO: 3016 - DNA, 352 bp, Artificial Sequence
  Synthetic construct
caggtgcagctggtgcagtctggggccgaggtgaagaaccctggggcctcagtgaaggtttcctgcaaggcatctggatacaccttcaccgactactatatgcactgggtgcgacaggcccctggacaagggcttgagtggatggggacaatcaaccctagtggtggtaacacaaagtacgcacagaagttccggggcagagtcaccatgaccagggacacgtccaccagcacagtatacatggacctgagcagcctgagatctgacgacacggccgtgtattactgtgcgagagcatacaattattcttgtggattctggggccagggaaccctggtcaccgtctcctcag

SEQ ID NO: 3017 - DNA, 370 bp, Artificial Sequence
  Synthetic construct
caggtgcagttggtgcagtctggggctgaagtgaagcagcctggggcctcagtgaaggtgtcctgcaaggcatctggatacaattttaccacatatcacatgcactgggtgcgacaggcccctggccaggggcttgagtggatgggattaatcaatcccaatgatggaaacacagccaacgaacagaagttccagggcagagtcaccatgaccagggacacgtccacgagcaccgtgtacatggagttgagcagcctgagatctgacgacacggccgtgttttactgtgtgataggccgagcagcaggtggaaggggcactgacgcttttgcgatctggggccaggggacaaagctcatcgtctcttcag

SEQ ID NO: 3018 - DNA, 367 bp, Artificial Sequence
  Synthetic construct
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggacctgagcagcctgagatctgaggacacggccgtgtattactgtgcaacagatctactatggttcggggagcgtgatgcttttgatatctggggccaagggacaatggtcaccgtctcttcag

SEQ ID NO: 3019 - DNA, 352 bp, Artificial Sequence
  Synthetic construct
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacttgggagcagggctggtcggtctactggggccagggaaccctggtcaccgtctcctcag

SEQ ID NO: 3020 - DNA, 379 bp, Artificial Sequence
  Synthetic construct
caggtccatcttgtgcagtctggggctgaggtgaagaagcctggggcctcagtgaaggtttcctgcaaggctactggatacaccttcagtatttatgctatgcactgggtgcgccaggcccccggacaaaggcttgagtggatgggacgcatcaacggtgacaatggtaacacaaaatattcacagaagttccagggcagaatcacccttaccagggacacatccgcgagcacagcctacatggaattgaacagtctgacatctgaagacacggctgtctattactgtacgagagttcgacttcgtatagatgcaataggggcccgcagcaactggttcgacccctggggccagggaaccctggtcaccgtctcctcag

SEQ ID NO: 3021 - DNA, 361 bp, Artificial Sequence
  Synthetic construct
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagtctcccaccagtctggtggtgcttttgatatctggggccaagggacaatggtcaccgtctcttcag

SEQ ID NO: 3022 - DNA, 358 bp, Artificial Sequence
  Synthetic construct
caggtgcagctggtggagtctgggggaggcgtggtccagcctggggggtccctgagactctcctgttcagcctctggatctaacttcaaaaactttggcatgcattgggtccgccaggccccaggcaaagggctggagtgggtggctgtcatatcatatgatgggaggcaagaattttacgcagactccgtgaagggccgattcaccatctccagagacaactccaagaaaacgatgtatctgcaaatgaacagtctgagacttgaggacacggctgtttattactgtgcgagagaccatgggagcgactggtacttcgatctctggggccgtggcaccctgctcactgtctcctcag

SEQ ID NO: 3023 - DNA, 364 bp, Artificial Sequence
  Synthetic construct
caggtccagcttgtgcagtctggggctgaggtgaagaagcctggggcctcagtgaaggtttcctgcaagacttctggatacaccttcactaggtatgctatgcattgggtgcgccaggcccccggacaaaggcttgagtggatgggatggatcaacgctggcaatgataacacaaaatattcacagaagttccagggcagagtcaccattaccagggacacatccgcgagcacagcctacatggagctgagcagcctaaaatctgaagacacggctgtgtattattgtgcgagagaaataactgagttttactatggttcgggggactactggggccagggaaccctggtcaccgtctcctcag

SEQ ID NO: 3024 - DNA, 376 bp, Artificial Sequence
  Synthetic construct
caggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagatcggctctgtagtggtggtagctgctactccgggtggttcgacccctggggccagggaaccctggtcaccgtctcctcag

SEQ ID NO: 3025 - DNA, 370 bp, Artificial Sequence
  Synthetic construct
caggtccagcttgtgcagtctggggctgaggtgaagaggcctggggcctcagttaatctttcctgcgagacttctggatacaccttcacaagctatgctatgcattgggtgcgccaggcccccggacaagggcttgagtggatgggatggatcaacactggcaagggctatacaaaatattcacagaaattccagggcagagtcaccattaccagggccacatccgcgaccacagtctatttgggcctgaacagcctgacatctgaagacacggcactatattactgtgcgagagatccaaccccttactatgaggggggttggtacttcgatctctggggccgtggcactttggtcactgtctccccag

SEQ ID NO: 3026 - DNA, 364 bp, Artificial Sequence
  Synthetic construct
caggtccagcttgtgcagtctggggctgaggtgaagaagcctggggcctcagtgaaggtttcctgcaaggcttctggatacaccttcattagttatgccatgcattgggtgcgccaggcccccggacagaggcttgagtggatgggatggatcaaccctggcaacggtaacacaaaatattcacagaagttccagggcagaatcaccattagcagtgacacatccgcgagtacagtctacatggaactgagtagcctgagatctgaagacacggctgtgtattactgtgcgagaaacctagattactatggtttgggggagttcgacccctggggccagggaaccctggtcaccgtctcctcag

SEQ ID NO: 3027 - DNA, 358 bp, Artificial Sequence
  Synthetic construct
gacgtccaagtggtacagtccggggctgaggtgaagaagcctggggccaccgtgaaaatctcctgtaaggcttctggatacaccttcaccgaccacttcatgcattgggtgcgccaggcccctggagaagggcttgagtggatgggacgtattaatcctgaaaatgatgaaaccatgtatgcagcgagattccagggcagagtcaccataaccgcagacacatccacagacacaacgtacatgcagctgaccagcctgagatctgacgacacggccgtgtattattgtgcaacactggcggttcgaagagtcccacgcccgtactggggccaaggaaccctggtcaccgtctcctcat

SEQ ID NO: 3028 - DNA, 358 bp, Artificial Sequence
  Synthetic construct
gaggtgcaactggtggagtctgggggaggcctggtcaaatctggggggtccctgagactctcctgtgcagcctctggattcaccttcagtgcctatagaatggactgggtccgccaggctccagggaaggggctggagtgggtctcatccattagttatagtagtaattacatatactactcagactcagtgaagggccgattcaccatctccagagacaacgccaagaattccctgcatctggacatggacagtctgagagtcgaggacacggctgtctattattgtgtgcgagcgcaccgggggagcccctactttgactcctggggccagggaaccctggtcaccgtctcctcag

SEQ ID NO: 3029 - DNA, 373 bp, Artificial Sequence
  Synthetic construct
gaggtgcagctggtggagtctgggggaggcttggtccagcctggagggtccctgagactctcctgtgcagcctctggattcaccttcagtgaccactacatggactgggtccgccaggctccagggatgggactggagtgggttggccgtgctggagacaaaattcacaattatatcatagaatacgccgcgtctgtggaaggcagattcaccatctcaagagatgaatcagagaactcgctgtatctgcaaatgaacaacctgagacccgaggacacggccatgtattattgtgctagagcctctgggggatctacagtccaccgctactatgactactggggccagggaaccctggtcagcgtctcctcag

SEQ ID NO: 3030 - DNA, 367 bp, Artificial Sequence
  Synthetic construct
caggtccaactggtggagtctgggggaggcgtggtccagcctgggaggtccctgagactcgcctgtgaagcgtctgggtttgccttcagccgctatggcatggattgggtccgccaggcgccaggcaagggtctggagtgggtggcaggtatatggtatgatggaagtaataaattttatgcagactccgtgaagggccgattcaccatatccagagacaattccaaggacacactttttctcgaaatgaacagcctgagagacgacgacacggctgtctactactgtgttaaagatggagacagcaacaccgcatacttccactttgacacttggggccagggaaccctggtcaccgtctcctccg

SEQ ID NO: 3031 - DNA, 385 bp, Artificial Sequence
  Synthetic construct
gaggtgcaactagtggagtctgggggagtcttgggacagccagggcggtccctgagactctcctgtacagcctctggattcaggtttggtgattatgccatggcctgggtccgccaggctccagggaaggggctgttgtggatcggtttcattagagataagtctcacggcgcgacaacggactatgccgcgcctctgaaaggcagattcgtaatctcaagagatgattccaaaagtgtcgcctatcttcaaatcgacagcctgagcaccgacgacacaggcttctattattgtactagagcctcttactgtattaatggaagatgcacgtcacctggcccctttgacttctggggccggggaaccctggtcaccgtctcctcag

SEQ ID NO: 3032 - DNA, 370 bp, Artificial Sequence
  Synthetic construct
gaggtgcagctggtggagactggaggaggcttgatccagccgggggggtccgtgagactctcctgtacagcctctgggttcaccgtcagcagctaccagatggcctgggtccgccagtctccagaaaaggggctggattgggtctcacttatttatatcggtggaagcacatactacgcagactccgtgaagggccgattcaccatctccagagacaattcgaagaacactctctatcttcaaatggacagcctgagagtcgaggacacggccgtgtattactgtgccagagggggcttccatgacgaataccgggccctttcgccctttgacttctggggccagggaaccccggtcagcgtctcatcag

SEQ ID NO: 3033 - DNA, 382 bp, Artificial Sequence
  Synthetic construct
gaggtgcagttggtggagtctgggggaggcctggtcaaggcgggggggtccctgacactctcgtgtgaagcctccggattcatgtttggtagttatgccatggcgtgggtccgcaaggcgccagggaaggggctggagtgggtctcctccattagtcacagtagtagttatgtaggatatgcagactcagtgaggggtcgattcaacatctccagagacgacgccaaaaattcattgtacctccacatgagcagcctgacaggcgacgacacggctgtctattactgtgcgagagaccgccttcatgacccatccgcggtgcgcttttttgactggtcgtttgacaagtggggccagggcgccctgctcaccgtgtccgcag

SEQ ID NO: 3034 - DNA, 373 bp, Artificial Sequence
  Synthetic construct
caggtgcaactggtggagtctgggggaggcatggtcatgcctggagggtccctgaggctctcctgtgcagcctctggattcaccttcaaagaccactatatggcttggatccgccagactccagggcagggactggagtggattgcatatgtcagtagtagtggacaaaccactgagtatggagactctgtgaagggccgattcaccgtctccagggacagcgccgagagtgcaatttttcttgaaatgaacaccctgagagtcgaggacacggctgtctatttctgtgcgagaatgtcttattacgatggaagtggttactacttcttctttgaccactggggccagggagcccaggtcaccgtctcctcag

SEQ ID NO: 3035 - DNA, 281 bp, Artificial Sequence
  Synthetic construct
ggacacctacatgggctggatccgccaggcaccagggaaggggctggagtggatttcatatattagtagtagtggtgatgacatgttctacgcagactctgtgaagggccgattcaccatctccagggacaacgccaagaactcactgtatctgcaaacgaacagcctgagagccgaggacacggctgtatattactgtgcgacagcgggggcccacagtaatggtttctattacggctttgagtcctggggccagggaacccgcgtcaccgtctcctcag

SEQ ID NO: 3036 - DNA, 369 bp, Artificial Sequence
  Synthetic construct
gaggtgcaactggaggagtctgggggagggttggtccagcctggggggtccctgagactctcctgtttagcctctggattcacctttagaaactattggatgggctgggtccgccaggctccagggaaggggctggagtgggtggccaacataaaacaagatggaagtgagaagtactatgtggacgctgtgaagggccgaatcaccatctccagagacaatgccaagaactcactgtatctgcaaatgaacagcctgagagccgaggacacggctgtatattattgtgcgaggttccccataacacctactgctaactattactacatggacgtctggggcaaagggaccacggtcaccgtctcctca

SEQ ID NO: 3037 - DNA, 358 bp, Artificial Sequence
  Synthetic construct
gaggcacaactgctggagtcggggggagacgtggtacgtccggggggctccctgagactctcctgttcagcctctggattcatctttggcaactatgccatgggctgggtccgccaggctccagggaaggggcttgagtgggtcgcaggcattagtcgtggtggtccctggacattctatatagagtccgtgaggggccgcttcaccatctccagagacaattccaggaacacgatggatctgcagatgttgtcgttgagagtcgaggacacggccttatattattgtgtgaaatatggtgcacaggaatggttaggggagtcttggggccagggaaccctggttgccgtctctgcag

SEQ ID NO: 3038 - DNA, 376 bp, Artificial Sequence
  Synthetic construct
gaggtgcagctggtggagtctgggggaggcttggtacagcctggagggtccctgagactctcctgtgcagcctctggattcaccttcagtacttatgagatggtctgggtccgccaggctccagggaaggggctggagtggatttcatacattagtagtagtgatactaccatatactacgcagactctgtgaagggccgattcaccatctccagagacaacgccaagaattcactgtatttgcaaatgaacagcctgagagtcgaggacacggctgtttattactgtgcgagagggttcgacgcttatgattttttgcctggctctccctactttgactactggggccagggaacccaggtcaccgtctcctcag

SEQ ID NO: 3039 - DNA, 370 bp, Artificial Sequence
  Synthetic construct
gaggtgcagctggtggagtctgggggaggcctggtcaagcctggggggtccctgagactctcctgtgcagtctctggattcatcctcagtgactatagcatggtctgggtccgccaggctccagggaaggggctggagtgggtctcgtccattgttactagtagtttttacataaactatgcagactcactgaagggccgattcaccatgtccagagacaatcccaagaagtccctgtatctgcaaatgaacagcctgagagccgaggacacgactgtgtgttgctgtgcgagactagtggagaggttctccccccacactttctactttcactactggggccagggaaccctggtcaccgtctcctcag

SEQ ID NO: 3040 - DNA, 384 bp, Artificial Sequence
  Synthetic construct
gaggtgcagctggtggagtccgggggaggcttagttcagcctggggggtccctgagactctcctgtgcagcctctggattcaccttcagtaactactggatgtactgggtccgccaagctccagggaaggggctggtgtgggtctcacgtattaacagtgatgggactagcacaacctatgcggactccgtgaagggccgattctccatctccagagacaacgccaagaacacgctgtatttgcagttgaacagtctgagagccgaggacacggctgtatattactgtgcaagagatcgatctccccttattaagatttttggagtgcttatgggctcctacatggacgtctggggcaaagggaccacggtcaccgtctcctca

SEQ ID NO: 3041 - DNA, 358 bp, Artificial Sequence; identical to SEQ ID NO: 1764
  Synthetic construct

SEQ ID NO: 3042 - DNA, 346 bp, Artificial Sequence
  Synthetic construct
gaggtgcagctggtggaatctgggggagacttggtccagccgggggggtccttgagactctcctgtgcagcctctggattcaccgtcaatagcaactacatgtcctggttccgccaggctccagggaaggggccggagtgggtctcagtcatttatgccggtggaagtacatattacgcagactccgtgaaggacagattcatcatctccagagacaattccaagaacaccttgtatcttcaaatgaacagcctgagagtcgaggacacggctatgtatttctgtgcgagagtcctatttggggggcccctgtggggccagggaaccctggtcaccgtctcctcag

SEQ ID NO: 3043 - DNA, 367 bp, Artificial Sequence
  Synthetic construct
gaggcggaattggtggaatctgggggacgcctggtcaagccgggggggtccgtcagactgtcttgtacagcctctggattcgcctttgttaaatacacgatgtcgtgggtccgccagtctccagggaagggactggaatgggtctcatccctttcctttggcagcgaattctcctactttgcagcctcactgcggggccgctctaacatctccagagacgatcttaccaattcgctttttctggacataagtctcctgagagtcgaagatacggctacatattactgtgcgcgcggtctcagtcccaactggtacttcgatgcttttgacatatggggccgggggaccacagtcaccgtctcttcag

SEQ ID NO: 3044 - DNA, 352 bp, Artificial Sequence
  Synthetic construct
gaggtgcagttggtggagtctgggggaggcttggttcagccgggggggtccctgagactctcctgtgcagcctctggattcacttttagtaactatgccatgttctgggtccgccaggctccagggaaggggctggagtgggtctctggtgttagtgttgctggtagtggcacattctacgcagactccgtcaagggccggttcaccatctccagagacaattccaacaacgcgctgtctctgcaaatgaacagcctgagagccgaggacacggccgtatattactgtgcgaaagaatttagaggagcttttgatatctggggccaagggacaatggtcaccgtctcttcag

SEQ ID NO: 3045 - DNA, 370 bp, Artificial Sequence
  Synthetic construct
caggtccagctggtgcagtctggggctgaggtgaaggagcctgggtcctcggtgaaggtctcctgccagacttctggaggcaccttcaatagtcatactattaattgggtgcgacaggcccctggacaaggtcttgagtgggtgggaggggtcgtccctatctttggtacaacaacctacgcagagaagtttcagggcagagtcacaattgccgcggacgcttccacgaacacagtctacatggagctcaggagcctgagatctgacgacacggccatgtattactgtgcgaggagacacagtggcgacgattcgcccagctacttctttgactactggggccatggaaccctggtcaccgtctcctcag

SEQ ID NO: 3046 - DNA, 367 bp, Artificial Sequence
  Synthetic construct
caggtgcaactggtgcagtctggggctgcggtgaagacgcctggggcctcagtgaaggtctcctgcaagacctctggttacaccttcgacgagtatgatattaattgggtgcgacaggcctctggtcaagggcccgagtggatgggatggatgaaccctgccagtggcaacacaggttatgcacagaagttccagggcagagtgatcttttctagggacacttcctcaaggacggcctatatggagatcagcagtctgacatccgacgacacggccctttatttttgcacgagaggccgatacccccgcatgcttcgcaggcactttgacttctggggccagggaaccccggtcatcgtctcctcag

SEQ ID NO: 3047 - DNA, 370 bp, Artificial Sequence
  Synthetic construct
caggtccagctggtgcaatctgaggctgaggtgaagaggcctgggtcctcggtcaaggtctcctgcagggcttctggaggcaccttcgacaactatgctattacctgggtgcgacaggcccctggacaaggtcttgagtggctgggagggacaatccctatcttcgacataccaaattccgcacagacgttgcacgccagagtcacgatcacgaccgacgagtccacgagcacagcctacatgcaactgagtagcctgacatctgaggacacggccgtctatttctgtgcgacccgaagacggatgttttcgaccaatgtcgattcttatgatatctggggccaagggacactggtcaccgtctcctcag

SEQ ID NO: 3048 - DNA, 367 bp, Artificial Sequence
  Synthetic construct
gaaatgcaactggcgcagtctgggcccgaggtgagaaagcctggggcctcagtgagggtggcctgcaagacgtctggtctcaagtttgacaattcagcaattcactggatgcgacaaagtcgtggactacgccttgagtggatgggatggatcgtcgttgccggaatgaagacaaactacgcaccgaatttcgaaaatagagtcacaattacacgagagttgtctaccgaaacagtgtttatggaattgagaagcctcacagccgacgacacggccatgtattattgtgcggcagtccctgggggcctcttaattcgcgaaacgttcgagtcgtggggccagggaaccctggtcaccgtctcctcag

SEQ ID NO: 3049 - DNA, 361 bp, Artificial Sequence
  Synthetic construct
gaggtccagctcgtacagtccggggctgaggtgaagaagcctggggccaccgtgagaatctcctgcagggcttctggatacaccttcaccgactactccattcactgggtgcaacaggcccctggaaaagggcttgagtggttgggtcgtgtagatcctgagaatggtgaaacaaaatatgcagagaactttcagggcagagtctccctgaccgcagacacgtctacagacacagcctacatggaactgagcagcctgagatctgacgacacggccgtttattactgtacaacagcccggggccgctggacctaccactttgcgtcctggggacagggagccctagtcaccgtctcctcag

SEQ ID NO: 3050 - DNA, 373 bp, Artificial Sequence
  Synthetic construct
caggtgcaattggtgcagtctggggctgaggtgaagaagcctggggcctcagtgaaggtctcctgcaaggcttctggatacaccttccccggccactttattcactgggtgcgacaggcccctggacaagggcttgagtggatgggatggatcaaccctgaaagtggtgtcgcaaaggttgcacggaagtttcagggcagggtcaccctgaccagggacacgtccatcagtacagtctacatggacctgagtaggctgcggtctgacgacacggccgtctattactgtgcaagagcggcgatttttggagtggttttttgggaaaactatttcgacccctggggccagggaaccctggtgaccgtctcctcag

SEQ ID NO: 3051 - DNA, 349 bp, Artificial Sequence
  Synthetic construct
caggtgcagctggtgcagtctggggctgaggtgaagaagcctggggcctcagtgaaggtctcctgcaaggcttctggatacaccttcaccggccactatattcactgggtgcgacaggcccctggacaagggcttgagtggatgggatggatcaaccctaacagtggcggcagaaactatgcacagaagttccaggacagggtcaccatgaccagggacacgtccatcagcacagcttacatggagttgagcaggctgagatctgacgacacggccgtgtattattgtgcgagatatgagtatgatcttgactactggggccagggaaccctggtcaccgtcacctcag

SEQ ID NO: 3052 - DNA, 385 bp, Artificial Sequence
  Synthetic construct
gaggtccagctggtgcagtccggggctgaggtgaagaagcctggggccaccgtgaaaatctcctgcaaggcctctggatacaccttcagcgacttctacattcactgggtggtacaggcccctggaaaagggcttgagtggatgggacgtgttgttcctgaagatggtgaaacactgtatgcagcgaagttccagggcagagtctccataaccgcagacacgtccacaaacacagcctacatggagctgagaagcctgagatctgaggacacggccgtattttactgtgcaacagagggggtcggaaggactaataaagcaggtgttggttgggatgatgcttttgatatctggggccaggggacaatggtcaccgtctcctcag

SEQ ID NO: 3053 - DNA, 382 bp, Artificial Sequence
  Synthetic construct
caggtgcaactggtgcaatctgggtctgaggtgaagaggactgggacctcagtgaaagtctcctgcaggacttctggatacaccttcgccgcctactctattcactgggttcgacaggcccctggacaagggcttgagtggatgggccggatcaattgtaacagtggtgccacaaactatgcgcagaggtttcagggcagggtcaccttgaccagagacatgtccatcgggacagcctacatggaactgagcaggctgacatctgacgacacggccctttatttctgtgcgaaatctaaaacccatactttttatcctggttcgggaggtcccacttacatcgacgactggggccagggaaccctggtcaccgtctccgccg

SEQ ID NO: 3054 - DNA, 369 bp, Artificial Sequence
  Synthetic construct
caggtgcaactggtgcagtctggggctgaggtgaagaagcctggggcctcagtgaaggtctcctgcaaggcttctggatacacctttaccgcccactatattcagtgggtgcgacaggcccctggacaagggcttgagtggatgggatggatcaaccctagcagtggtggcacaaagtctgcacagagttttcaggacagagtcaccgtgaccagggacacgtccatcaacacggcctacctggaactgaggaggttgagatctgacgacacggccgtttattactgcgcgagagtgatggaaacagccatggcccccgactactacatggacgtctggggcaaagggaccacggtcaccgtctcctca

SEQ ID NO: 3055 - DNA, 373 bp, Artificial Sequence
  Synthetic construct
caggtccgacttgtgcaatctggggctgaattgaagaagcctggggcctcagtgaaggtttcctgcaaggcttctggacacaccttcattgactatgctattcattggctgcgccaggcccccgggcaaaggcctgagtggttgggatacatcaatgctgacaatggtcgaacgagatattcaccgacatggcagggcagagtcacgtttgccagggacccaaccacgagtacggcctatatggaggtgaacagtctgacaacgtcagacacggctgtcttttattgtgcgagcgcgaactggactgcggtgatttcaacaaccgataccctccatgtctggggccaagggacattggtcaccgtctcctcag

SEQ ID NO: 3056 - DNA, 364 bp, Artificial Sequence
  Synthetic construct
gcagtgcagctgttggagtctgggggaggcttggcacagccgggggggtccctgagactctcctgtgcagtctccggattcacctttaacacctatgccattcattgggtccgccaggctccaggcaaggggctggagtgggtctcggttatcagtggaggtggaggtaccacttactacgcagactccgtgaagggccggttcaccatctccagagacaattccaaggacaccttgtatctgcaaatgaacagcctgcgagccgaggacacggccgtatactactgtgcgaaggtgctgctgggagctcttaccgatgctttcgatatctggggccaagggacaatggtcaccgtgttttcag

SEQ ID NO: 3057 - DNA, 370 bp, Artificial Sequence; identical to SEQ ID NO: 1767
  Synthetic construct

SEQ ID NO: 3058 - DNA, 388 bp, Artificial Sequence
  Synthetic construct
gaggtccacctgctacagtccggggctgaggtgaagaagcctggggcctccgtgaaaatctcctgcaaggcttctggatacaccttcaccgactactacatttactgggtgcaacaggcccctggaaaaggccctgagtggatgggacgtgttgatcctgaagatggtgaaacaatatctgcagagaagttccagggcagagtcaccataaccgcagacacgtctacagacacagccttcatggacctgagtagcctgagatctgaggacacggccgtgtattactgtgcaacctcccctaagtttgatgataacgcctgggggacttttcgtgatacggccacacctgactactggggccagggaaccctggtcaccgtctcctcag

SEQ ID NO: 3059 - DNA, 369 bp, Artificial Sequence
  Synthetic construct
caggtgcagttggtggagtctgggggaggcgtggtccagcctgggaggtccctgagactctcctgtgcagcctctggatacagtttcgccagttatggcctacactggctacgtcagactccaggcaaggggctggagtggttggctggtgtttcgtctgatgcatccaaaaaagactacgcagactccgtgaagggccgattcaccatttcaaaagacaatatgaggaacacactgtatttgcaactaaatagcctgagacctgaggacacggctgtctttttctgtgccagaggcgataggtcgataatagtaggtcaattttacatggacgtctgggggaaagggaccacggtcatcgtctcctca

SEQ ID NO: 3060 - DNA, 367 bp, Artificial Sequence
  Synthetic construct
caggtccacctggtgcagtctggggcagaggtgaagaagccggggtcctcggtgaaggtctcctgccaggcatctggagggaccttcaggagtcactatctcacctgggtgcgacaggcccccggacaggggcttgagttcatgggagggatcctccctgttattgaaaaaccagactacgcacagaagtttcagggcagggtcacgatcaccacggacgaagacacgagcactgcctacttggttttgaccagtctgacatcagaagacacggccgtatatttctgtgcgcgatgtaaggccgaatatacgactggttgccccggggactattggggcccgggaaccctggtcatcgtctcgtcag

SEQ ID NO: 3061 - DNA, 361 bp, Artificial Sequence
  Synthetic construct
cagctccagctggagcagtctggggctgaggtgaagaggcctgggtccgcagtgaaggtctcctgcatggcttctggagacgccttcagcagccatgctctcagctggatccgacaggcccctggacaagggcttgagtgggtgggagccatcatccctctctttggttcaccaaactacgcacagaagttccaggacagagtcacaattaccgcggacatgtccacgagtacagcctacatggaaattagtggcctgacatctgaggacacggccatctattactgtgcgcgacggttttattcttatggttttgcctttgatatctggggccgggggacaatggtcatcgtctcttcag

SEQ ID NO: 3062 - DNA, 379 bp, Artificial Sequence
  Synthetic construct
caggtccacctggagcagtctggggctgaggtgaagaagcctgggtcctcggtgaaggtctcctgcaaggcttctggaggcaccctcagcgacttatctctcagctgggtgcgacaggtccctggacaagggcttgagtggatggggggggtcatccctgtacttgggacatcagacatcgctcaggcattccaagacagagtcactcttaccagggacgaatctaagaatacagcctacatggaactgagcaacctgagatctggggacacggccatttattactgtgcgagaggttggggtatatcgattggtggagcgacaaccaccaagtggctccacccctggggccagggaacccgggtcaccgtctcttcag

SEQ ID NO: 3063 - DNA, 382 bp, Artificial Sequence
  Synthetic construct
caggtccagctggtgcagtctggggctgaggtgaagaagcctgggtcctcggtgaaggtctcctgcaaggcttctggaggctccttcagcggctttggtctcagttgggtgcgacaggcccctggacaagggcttgagtggatgggaggaatcatccccgtgtttggtgcaccaaattacgcacaaaagttcaagggcagagtcacgattagtgcggacgactccccgagtgcagcctacttggagctgagcagcctgacacctgaagacacggccatttattactgtgcgagagagggggcaggctattactatgatagcagtggcctgggatatggctttgatatctggggccaagggacaattgtcaccgtctcctcag

SEQ ID NO: 3064 - DNA, 358 bp, Artificial Sequence
  Synthetic construct
gaggtgcaactggcggagtctgggggaggcctggtcaagcctggggggtccctgagactctcctgtgcagcctctggattcaacttctattcctataccctgaactgggtccgccaggctccagggaaggggctggagtggatcgcatccatcagtggtaatagtggttacaagtacttcgcaaactcagtgaagggccgaatcaccatctccagagacaactccaagaactcactgtttctgcaaatcaacagcctgcgagacgaggacacggctacttattactgtgcgagagctgatagcaccgactggcaaatggactactggggcctgggaaccctggtcaccgtctcctcag

SEQ ID NO: 3065 - DNA, 355 bp, Artificial Sequence
  Synthetic construct
ggggtgcagctggtggagtctgggggaggcttggtacagcctggagggtccctgagactctcctgtgcagactctggattcaccttcagtaattatgaactgaactgggtccgccaggctccggggaagggactggagtggatttcatacatcactactagtggtggtaccatatactacgcagactctgtgaagggccgattcaccatctccagagacaactccaagagctcactgtatctgcaaatgaacagcctgagagtcgaggacacggctgtttattattgtgcgagacgatatggcttcactcccctcgacttctggggccagggaaccctggtcaccgtctccccag

SEQ ID NO: 3066 - DNA, 379 bp, Artificial Sequence
  Synthetic construct
caggtacaactggtgcaatctgggtctgagttgaagaagcctggggcctcagtgaaggtttcctgcaaggcttctggatacaccttcactaattatgctctgaattgggtgcgacaggcccctggacaagggcttgagttgatgggatggatcaacacctacactgggaccccaacgtatgcccagggcttcccaggacggtttgtcttctccttggacacctctgtcagcacgacatatctgcagatcagcagcctaaaggctgaggacactgccatgtatttctgtgcgagagataatcggccttattatgatatgagtgggtattcacctgaccttgactactggggccagggaaccctggtcaccgtctcctcag

SEQ ID NO: 3067 - DNA, 367 bp, Artificial Sequence
  Synthetic construct
gaggtacagctggtggagtctgggggaggcttggtccaggctggggggtccctaagactctcctgtacagcctctggattcacatttagttccttttggctgacctgggtccgccagactccagggagggggttggagtgggtggccaatataaacaaagatgggactaagacgtcctatgtggactctgtgctgggccgattcaccatctccagagacaacgccaagaactcactgtatcttcacgtgagcagcctgagagtcgaggacacggcaatgtattactgtgcgagagagacgtggggattccttggagggggctactttgactattggggccagggagtcctggtcaccgtctcctctg

SEQ ID NO: 3068 - DNA, 364 bp, Artificial Sequence
  Synthetic construct
gagattcagttgttggagtctggaggaggcttggcacagcctggggggtccctgacactctcctgtgcagcctctggattcactttttccatttatgccctgacctgggtccgccaggctccagggaagggactggagtgggtcgcccaaattagtaacagtggtcataaaacatattatgcagactccgtgaagggccggttcaccatctccagagacaattccaagaacatgatatatctggaaatgaacagcctgcgagccgacgacacggccctatattactgtgcgaaatatcgcccaggacctaagaatgatgctttgcatgtctggggccaagggacaagggtcaccgtctcttcag

SEQ ID NO: 3069 - DNA, 358 bp, Artificial Sequence
  Synthetic construct
gaggtgcacctggtggagtctgggggaggcttggtccagcctggggggtccctgagactctcctgtacagcctctggattcacctttagttccttttggctgagctgggtccgccaggctccagggaaggggctggagtgggtggccagcataaagcaggatggaagtgaaatccaccttctggactctgtgaagggccgattcaccatctccagagacaacgccaagaactcagtgtatctgcaaatgaacagcctgagaggcgaggacacgggaatgtattactgtgcgcgaatttattatagtgggacgtaccaagactactggggccagggaaccctggtcaccgtctcctcag

SEQ ID NO: 3070 - DNA, 387 bp, Artificial Sequence
  Synthetic construct
gaggtgcaactggtggagtctgggggaggggtggttcagccagggcggtccctgagactctcctgtaaaggttctggattcaagtttggtgattatggtctgagctgggtccgccaggctcccgggaaggggctggagtgggtcgctttcgtgaaaagtagagttaatagtgggacaacagaatatgccgcgtctgtgaaaggcagaagtaacatcacaagagatgattccagaaacatcgtctatttatatgtggacagcctgaaaatggaggacacggccgtctattattgtactcgagataaaggaatgtatgactggaactccgggacctacctctactacatggacgcctggggcaaagggaccacggtcaccgtctcctca

SEQ ID NO: 3071 - DNA, 379 bp, Artificial Sequence; identical to SEQ ID NO: 1763
  Synthetic construct

SEQ ID NO: 3072 - DNA, 358 bp, Artificial Sequence
  Synthetic construct
gacgtgcagttggtggagtctgggggaggcttggtgaagccgggggggtcccttagactctcctgtgcagcctctagatcctctttcagtgacgactggctgagttggatccgcctgagtccaggcaaggggatggagtgggttggccgtattaaaagcaaaattgatggtgggacggcggactacgctgcagccgtgagaggcagattcaccatctcaagagacgattcaaaaaaaactctctatctgcaaatgaatagactgaagatggaggacaccgccgtgtattactgcaccgtccacattggcaccagcgctaacttctggggccagggaacccaggtcaccgtcgcctcag

SEQ ID NO: 3073 - DNA, 324 bp, Artificial Sequence
  Synthetic construct
gggagaggttctgggttcatctttggtgattatgcgctgagttgggtccgccaggctcccgggaagggtctggagtgggtagggctcatgaaaaggagatcttatggtgtgacaacagactacgccgcgtctctgaaaggcagattcaccattacaagagatgatcccaaaaacatcacctatctacaaatgaacagcctgacaaccgaggacacagccgtctattattgtactagagatcgaggaacgtatgactggaactacgggacctacttctactacatggaagtctggggcaaagggaccacggtcaccgtctcatca

SEQ ID NO: 3074 - DNA, 387 bp, Artificial Sequence
  Synthetic construct
gaggtgcagctggtgcaatccggggggggcctggtgcagccagggcggtccctcagactctcctgtagaggttctgggttcatctttggtgattatgcgctgagttgggtccgccaggctcccgggaagggtctggagtgggtagggctcatgaaaaggagatcttatggtgtgacaacagactacgccgcgtctctgaaaggcagattcaccattacaagagatgatcccaaaaacatcacctatctacaaatgaacagcctgacaaccgaggacacagccgtctattattgtactagagatcgaggaacgtatgactggaactacgggacctacttctactacatggaagtctggggcaaagggaccacggtcaccgtctcatca

SEQ ID NO: 3075 - DNA, 366 bp, Artificial Sequence
  Synthetic construct
caggtgcagctggtacaatctggccctgagctgaagaagcctggggcctcagtgaaaatttcctgccaggcatctggatacaccttcaccgaccactatctgcactgggtccgacaggcccctggacaagggcttgagtggatgggaatgctcaaccctagtggtgataccaaagcctacgcacagaagttccagggcagagtcgccatggccagggacacgtccacgaccacattctacgtggagttgagcagtctgacatctgacgacacggccttatatttctgtgcgagagggggacgcacctttggttatacgtgggagttctttgacaactggggccagggaaccctggtcaccgtctcc

SEQ ID NO: 3076 - DNA, 369 bp, Artificial Sequence
  Synthetic construct
caggtgcagctggtggagtctgggggaggcgtggtccagcctgggacgtccctgagactctcctgtgcaggctctggattcacgttccgtaattatggcctgcactgggtccgccaggctccaggcaaggggctggagtgggtgtcagttatttcatttcacggaaacaatgaaaactacgcagcctccgtgaatgggcgattcaccatctccagagacaactccaagaacacgttatatctccaaatgaacagcctgagacctgaagacacggctgtttattactgtgcgagagagagaagtccgagagtcgactactaccactacatggacgtctggggcaatgggaccacggtcaccgtctcctca

SEQ ID NO: 3077 - DNA, 361 bp, Artificial Sequence
  Synthetic construct
cagatcacgttgagggagtctggtcctgcggtggttctccccacacagaccctcacactgacctgcaccttctctgaagtctctcaaaattctaatgcagcgggtctgggctggttccgtcggcccccaggaaaggccctagagtggcttgcattcactttctggaatgatgataggatttacagtccatctctgagtaacagactcaccatcaccaaggacacctccagacaccaagtggtcctcacattgaccgacgtgggccctgttgacacagccacatacttctgtgcacacagtccaacatattccaacatctttgacttctggggccaggggatcctggtcaccgtctcctcag

SEQ ID NO: 3078 - DNA, 370 bp, Artificial Sequence
  Synthetic construct
caggttcaccttgagcagtctggagatgaggtgaagaagcctggggcctcagtgaaggtctcctgcaagacttctggttacacctttaccagttatagtcttatctgggtgcgccaggcccctggacaagggcctgaatgcatgggatggatcaccgtctatagtggtaacataaagtatgcacagaacttccagggcagaatgaatgtgaccatagacacacccacgagcacagcctacatggagctgaggagcctgaaatctgacgacacggccgtgtattactgtgtaagagcatattgtagtagtagcagctgcccaggcggttttgacttctggggccagggaaccctggtcaccgtctcgtcag

SEQ ID NO: 3079 - DNA, 358 bp, Artificial Sequence
  Synthetic construct
caggtgcaggtgctggagtctgggggaggcgtggtccagcctgggaggtccctgagactctcctgtgcagcctctggattcacctttagttcgtatggcgtacactgggtccgccaggctccaggcaaggggctggagtgggtggcagtgacatcttttgatgggagatttaaatattacgcagactccgtgaagggccgattcaccttcgccacagacatttccaagaacaccttttatctgcaaatgaaccgcctgcgagttgaggacacggctatatattactgtgcgaagggccgtgcaaattggcgatactttgacctctggggccagggaaccctggtcaccgtctcctcag

SEQ ID NO: 3080 - DNA, 367 bp, Artificial Sequence
  Synthetic construct
caggtccagcttgtgcagtctggggctgaggtgaagaagcctggggcctcagtgaaggtttcctgcaaggcctctggattcaccctcagaaattatgctgtacattggatgcgccaggcccccggacaacggcttgagtggatggggtggatcaacgctggcaacggttacacacaatattcgcagaatttacaaggcagagtcaccattaccagggacacatccgcgagcacggttgacatggaactgaggagcctgacatctgtagacacggctgtgtattactgtgcgagaattagagtcggggaattatttttcggcacctttgacttctggggccagggaaccctggtctccgtctcctcag

SEQ ID NO: 3081 - DNA, 378 bp, Artificial Sequence
  Synthetic construct
caggtgcagctggtgcagtctggggctgaagtgaagaagcctggggcctcagtgacggtctcctgcaaggcttctggatacaccctctccacctatgatgtcaactgggtgcgacaggccactggacaaggccttgagtggttgggacggatgaaccctgaccgaggcaacacggtctcttcacagaagttccagggcagagtcacctttagcgtgaacacctccttgaatacagcctacatggcgctgagcagcctcacatctgaagacacggccgtctactactgtgcgagaggacgttttcagagagtgggaggcgtctacacctacttctacatggacgtctggggcacagggaccacggtcaccgtctcctcc

SEQ ID NO: 3082 - DNA, 367 bp, Artificial Sequence
  Synthetic construct
caggtccaggtggtgcagtctggggctgaggtgaagaagcctgggtcctcggtgaaggtctcctgcgagactcttggaggcaccttcatcagttatagtgtcaactgggtgcgccaggcccctggacatgggcttgagtggatgggaggcatcatccctggctttggtgtggtgaattatgcacggatgttccagggcagagtcacgattaccgcggacgaatcgtcgaaaactgcctacatggagttgaaacgcctgacatctgaggacacggccgtctattactgtgtgaactccttcaaatacaggagcaacccgggggacttcggctcctggggccagggaaccctggtcaccgtctcctcgg

SEQ ID NO: 3083 - DNA, 379 bp, Artificial Sequence
  Synthetic construct
caggtccagctggtgcagtctggggctgaggtgaagaagcctgggtcctcggtgaaggtctcctgcaaggcttctggaggcaccctcaccgactactctgtcacctgggtgcgacaggcccctggacaagggcttgagtggatggggggggccgtccctgtccttgggacttcagacatcgcacagaagttccgtgacagagtcactttttccgcggacccatcgacaggaactgtctacatggagctgactgacctcagatttggggacacggccacctactactgtgcgagaggttggggtattacgatttctggagcgtctaccagcaagtggctccacccctggggccagggaactctggtcaccgtctcctcct

SEQ ID NO: 3084 - DNA, 394 bp, Artificial Sequence
  Synthetic construct
caggtccagctggtgcagtctggggctgcgatgaagaagcctgggtcctcggtgagggtctcctgcaaggctgctggaggcaccctcagcacctatggtgtcacctgggtgcgccaggcccctggacaagggcttgagtgtgtgggacagatcatccctatctttggtacaacaaactacgcacagaaattccagggcagagtcacaattagcgcggacgaatctacgaacacagtttacatggacctgagcagcctgagatctgaagacacggccatgtattactgtgcgagatttggctctccaactctccttattgactacggtgactacgaaaaggtgatcggtgctttggatgtctggggccaagggacaatggtcaccgtctcttcag

SEQ ID NO: 3085 - DNA, 385 bp, Artificial Sequence
  Synthetic construct
caggtcctgctggtgcagtctggggctgaggtgaagaagcctgggtcctcgataaaggtctcctgcaaggcttctggggggaacttcagcaggaccgttgtcacgtgggtgcgacaggcccctggacaagggcttgaatgggtgggagagagcattcctatcttgggaacagcgaagtacgcacagaagttccaggacagagtcacaattacatcggacgaatcctcgaccactgcctacctagacctgcgcaacctgacatctgaagacacggccgtctattactgtgcgagaggtcacagaatatattatgatattagaagttattacggagagtcctggctcgacccctggggccagggaactctggtcaccgtctcctcag

SEQ ID NO: 3086 - DNA, 361 bp, Artificial Sequence
  Synthetic construct
cagttcaccttgaaggagtctggtcctgtgctggtgaaacccacagagaccctcacgctgacctgcaccgtctctgcgttctcactcagcaatgttaaaatgggtgtcagctggatccgtcagcccccagggaaggccctggagtggcttgcacacattttttcgaatggcgaaaaatcctacagtacatctctgaagaccagactcactatctccaaggacacctccaaaagtcaggtggtccttatcatgaccaatttggaccctgtggacacagccacatattactgtgcacggatgctggcccgacagaattacttcgacccctggggccagggaacccaggtcaccgtctcctcag

SEQ ID NO: 3087 - DNA, 373 bp, Artificial Sequence
  Synthetic construct
caggtcaccttgagggagtctggtcctgcgctggtgaaacccacacagaccctcacactgacctgcaccttctctgggttctcactcagcactagtggaatgtgtgtcagctggatccgtcagcccccagggaaggccctggagtggcttgcacgcattgattgggatgatgataaatactacagcacatctctgaagaccaggctcaccatctccaaggacacctccaaaaaccaggtggtcctttcaatgaccaacatggaccctgtggacacagccacgtattactgtgcacggattctggaccctcattactatggttcgggggctattgactactggggccagggaaccctggtcaccgtctcctcag

SEQ ID NO: 3088 - DNA, 373 bp, Artificial Sequence
  Synthetic construct
caggtccaattgattcaatctgggcctgaggtgaagaagccggggtcctcgttgaaggtctcctgcaaggggtctggggtctccgtcatcaacgatgcagtcagctgggtgcgacaggcccccggacaaggccttgagtggatgggcggactcatccctctcttacggatccccaactacgcagcgcacttcaaagacagattgaagatgaccacggacgagtccacaaacaccgccttcatggaactgagcaatctgacttctgacgacacggccacatactactgctcgacagatgcttccaatgattacacctgggggagttatcgcctagaccactggggccagggaaccctggtcaccgtctccccag

SEQ ID NO: 3089 - DNA, 379 bp, Artificial Sequence
  Synthetic construct
caggttcagttggtgcagtctggagctgaggtgcagaagcctggggcctcagtgaaggtctcctgcacggcctctggttacgccttaagtgattatggtgtcagttgggtgcggcaggcccctggacaagcacctgagtggatgggatggatcaacccttacaatggtgacacaaaatattcacagaggctcgagggcagagtcaccatgaccacagacacatccacgaacacagcctacatggagctgaggaggctgagatctgacgacacggccgtttattactgtgcgagagatggtctttattgtagtaggagtggctgtttcgcggactggctcgacctctggggccagggaaccctggtcaccgtctcctcag

SEQ ID NO: 3090 - DNA, 358 bp, Artificial Sequence
  Synthetic construct
gaggtgcagttggtacagtctggaacagaggcgaagaagccgggggagtcgctgaagatctcctgtaaggcttctggatatagttttaccagttactgggtcggctgggtacgccagacgcccgggaaaggcctggagttgatggggatcatctatcctcgtgactccgataccagatacagcccgtccttccgaggccaggtcattatttcagccgacaagtccgtcgagaccgcctacctgcagtggagcagcctgaagtcctcggacactgccatctattactgtgtgagactgactgcggtgactcactactttgactactggggccagggaaccctggtcaacgtctcctcag

SEQ ID NO: 3091 - DNA, 367 bp, Artificial Sequence
  Synthetic construct
gaggtgcagctggtgcagtctggagcagaggtgaaaaagccgggggagtctctgaagatctcctgtaagggttctggatatagttttgcgacatactgggtcggctgggtgcgccagatgcccgggaaaggcctggagtggatgggtatcatctatcctggtgactctgacaccagatatagcccgtccttccaaggccaggtcaccatctcagccgacaagtccatcaacaccgcctacctacagtggagtagcctgaaggcctcggacaccgccatgtattattgtgcgaggccccggaggagtggctacaattatgttggttttgatgtctggggccaagggacactggtcaccgtctcttcag

SEQ ID NO: 3092 - DNA, 361 bp, Artificial Sequence
  Synthetic construct
caggtgcagctgcagccgtggggcgcaagactgttgaagccctcggagaccctgtccctcacgtgcgctgtgtctgctgcgtcattcagtggtaattacgtgacctggattcggcagccccccgggaagggcctggagtggattggggaaatcactcgaagtggaaacaccaactacaccccgtcgctcaagagtcgagtcaccatttcactagacacatccaagaatctggtgtccctgaggttgcggtctgtgaccgccgcggacacggctctttataactgtgcggtggccgcttacccggggagaggtaggcgtctcgacccctggggccagggaaccctggtctccgtctcctcag

SEQ ID NO: 3093 - DNA, 346 bp, Artificial Sequence
  Synthetic construct
gagatgcaggtggtggaatctggaggaggctgggtccggcctggggggtccctgagactctcctgtgcagcctctgggttcagcgtcagtgaccatcacgtgacctgggtccgccaggctccagggaaggcactggagtgggtcggagttatttatgacgatggcagaacattctatgaagactccgtgaagggccgattcatcatatccagacacagttccaagaacatcgtgtatcttcaaatgaacaccctgatacttcaggacgcggccgtctatttttgtgccagaggagttcgatattacgccccctggggccaggggacccgggtcaccgtctcctcag

SEQ ID NO: 3094 - DNA, 367 bp, Artificial Sequence
  Synthetic construct
gaggagcagctggtggagtctgggggaggcttggtacagccagggcggtccctgagactctcctgtacaggttctggattcatttttggtgattatgctgtgacctgggtccgccaggctccaggggaggggctggagtgggtaggtttcattaaaagcaaagcttatggtgggacaacagaatacgccgagtctgtgaaaggcagattcaccatctcaagagatgattccaaaagtatcgcctatctacaaatgaacagcctgaagaccgaggacacagccgtgtattactgtactagtccctcggggagttattaccccctcccctactactggggccagggaaccctggtcaccgtctcctcag

SEQ ID NO: 3095 - DNA, 393 bp, Artificial Sequence
  Synthetic construct
caggtcaccttgagggagtctggtcctgcggtggtgaaacccacacagaccctcacactgacctgcaccgtctctgggttctcagtcagcaccagtggaatgtgtgtgagctggatccgtcagcccccagggaaggccccggagtggctagcacgcattgattgggatgatgataaattttacaagacatctctgaagaccagactcaacatctccaaggacacctccaaaaaccaggtggtccttacaatgatcaacatggaccccgtggacacagccacatattattgtgtacgggtaaaatattacgatgttgtgactggccatcctacggcctaccattcctactacatggacgtctggggcaaagggaccacggtcaccgtctcctca

SEQ ID NO: 3096 - DNA, 369 bp, Artificial Sequence
  Synthetic construct
caggtcaccttgagggagtctggtcctgcgctggtgaaacccacacagaccctcacactgacctgcaccttctctggattctcactcagcactagtggaatgtgtgtgagctggatccgtcagcccccagggaaggccctggaatggcttgcacgcattgattgggatgatgataaatactacagcacatctctgaagaccaggctcaccatctccaaggacacctccagtaaccaggtggtccttacaatgaccaccatggaccctgtggacacagccacgtatttctgtgcacgggcggcgtgtagtggttattactactactacatggacgtctggggcaatggggccacggtcaccgtctcctca

SEQ ID NO: 3097 - DNA, 376 bp, Artificial Sequence
  Synthetic construct
caggtcaccttgaaggagtctggtcctgtgctggtgaaacccacagagaccctcacgctgacctgcaccgtctctgggttctcactcaccaatgctagaatgggtgtgagctggatccgtcagcccccagggaaggccctggagtggcttgcacacattttttcgaatgacgaaaaatcctacagcacatctctgaagagcaggctcaccatctccaaggacccctccaaaagccaggtggtccttaccatgaccaatctggaccctgtggacacagccacatattactgtgcacggatcccacccaacacacagctatgggccaattactactttgactactggggccagggaaccctggtcaccgtctcctcag

SEQ ID NO: 3098 - DNA, 367 bp, Artificial Sequence
  Synthetic construct
caggtcaccttaaaggagtctggtcctgttctggtgaaacccacacagaccctcactctgacctgcgccttctctggtttctcactcacgacatctggaatgtgtgtgagctggatccgtcagcccccagggaaggccctggagtggcttgcacgcatagattgggatgatgataaattttacaactcatctctgaggtccagactcaccatctccaaggacacctccaaaagccaagttgtccttacactgaccaacatggaccctgtggacacaggcacctatttctgtgcacggtcatttctgcctacatccagttattcttttgacttctggggccagggggccctggtgaccgtctcctcag

SEQ ID NO: 3099 - DNA, 390 bp, Artificial Sequence
  Synthetic construct
caggtcaccttgaaggagtctggtcctgtgctggtgaaacccacacagaccctcacactgacctgcaccttctctgggttctcactcaacactagtggaatgtgtgtgagctggatccgtcagcccccagggaaggccctggagtggcttgcacgcattgattgggatgatgataaattctatagcacatctctgaagaccaggctcaccatctccaaggacacctccaaaaaccaggtggtccttacaatgaccaacatggaccctgtggacacagccacgtattactgcgcacggacactggttactaatgtggcagcagctgggaattactactaccactactacatggacgtctggggcaaagggaccacggtcaccgtctcctca

SEQ ID NO: 3100 - DNA, 370 bp, Artificial Sequence
  Synthetic construct
caggtcaccttgaaggagtctggtcctgtgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatggaccctgtggacacagccacgtattactgtgcacggataaggtactatggttcggggagttgttactttgactactggggccagggaaccctggtcaccgtctcctcag

SEQ ID NO: 3101 - DNA, 358 bp, Artificial Sequence
  Synthetic construct
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagtacatctctgaagaccaggctcaccatctccaaggacacctccaaaaaccaggtggtccttacaatgaccaacatggaccctgtggacacagccacgtattactgtacacggcctgagaggaacgggcagatcgactactggggccagggaaccctggtcaccgtctcctcag

SEQ ID NO: 3102 - DNA, 361 bp, Artificial Sequence
  Synthetic construct
caggtcaccttgaaggagtctggtcctgtgctgctgaaacccacagagaccctcacgctgacctgcaccgtctcgggcttctcactcagcgatcctagaatgggtgtgagctggatccgtcagcccccagggaaggccctggagtggcttgcccacattttttcgaatgacgccaagtcctacaggccgtccctgaagagtcggctcaccatctcccaggacacctccaagaaccaggtgttccttaatatgaccaatgtggaccctggggacacagccacttactattgtgcacggaattcgaggcgggagagctttttcgacccctggggccagggaaccctggtcaccgtctcctcag

SEQ ID NO: 3103 - DNA, 382 bp, Artificial Sequence
  Synthetic construct
gaggtgcagctggtggagtcggggggaggcctggcacagccagggcggtcgctgacactctcctgcacgggttccgggttcaccttaagtgatcattctgtgagctgggtccgccaggctccaggcaaggggctggagtgggtaggtttcattagaaacttcaattacggtggaacaccggaatacgccgcgtctgtgcggcgcagattcaccatctcaagagatgattccaaaaacatcgtctatctgcaaatgaacagcctgagaaccgaggacacaggcgtctattactgtgttagagaggccccttcttactatgatgccagtggttatttctactttgactactggggccagggagccctggtcaccgtctcctcag

SEQ ID NO: 3104 - DNA, 370 bp, Artificial Sequence
  Synthetic construct
caggtcaccttgagggagtctggtcctgcgctggtgaaatccacacagaccctcacactgacctgcaccttctctgggttctcactcaccactagaggaatgtgtgtgagctgggtccgtcagcccccagggaagggcctggagtggcttgcacgcattgattgggatgatagtaaatactacagcacatctctgaagaccaggctcaccatctccaaggacacctcaacaaaccgggtggtcctgacaatgaccaacatggaccctgtggacacagccacttattactgtgcacgggaggattttgatagtggaggttatcatgcatttgatatctggggccaagggacaatggtcgccgtctcttcgg

SEQ ID NO: 3105 - DNA, 367 bp, Artificial Sequence
  Synthetic construct
gaggtcgttttgttggagtcgggggggggcttagtgcagccgggcgggtctctgagactctcctgtggaggctctggattcactttttacaactacgccgtgagttgggtccgcctgagtccagggaaggggctggagtgggtctcaggtattagtgccacaggtggcggcgcctattacagagactctgtgagggggcgcttcaccgtgtcccgagacaactccaaaaatacagtgtttctgcaaatggacaacctgggagtcgacgacacgggcatttacttctgtgcgaaggatcgtgacatggccacactttggggacacttccaacactggggccagggcaccgtagtcaccgtctcttcaa

SEQ ID NO: 3106 - DNA, 376 bp, Artificial Sequence
  Synthetic construct
caggtcaccttgagggagtccggtcctgcgctggtgaaacccacacagaccctcacaatgacctgcaccttctctgggttctcattcagtactagtggaatgtctgtgagttggttccgtcagcccccagggaaggccctggagttccttgcacgcattgattgggataatgatagattttacagcacatctctgaaggccaggctcaccgtctccaaggacacctccaaaaaccaggtggtcctcacaatgaccaacatggaccctatagacacagccacgtattactgtgcacggatgcgggtagtcgggtccggttcggggactcgttactttgactactggggccagggatccctggtcaccgtctcctcag

SEQ ID NO: 3107 - DNA, 358 bp, Artificial Sequence
  Synthetic construct
cagatcaccttgaaggagtctggtcctacgctggtgaaacccacacagaccctcacgctgacctgcaccgtctctggggtctcactcgatagtagtggagtggctgtgcactggatccgtcagcccccaggagcggccctggagtggcttgcactcatttattggaatgatgatgagcgctacaggccatctctgaagagcagactcaccatcaccaaggacacctccaaaaaccaggtggtccttacaatgaccaacgtggaccctgtggacacagccacatatttctgtgcacaatcctacgtttcggggagtatcaaatcctggggccagggaatcctggtcaccgtctcctcag

SEQ ID NO: 3108 - DNA, 382 bp, Artificial Sequence
  Synthetic construct
cagatcaccttgcgggagtctggtccaacggtggtgaaacccacacagaccctcacgctgacctgcagcttttctgggttctcactcagttctattggagaggctgtgggctggatccgacagcccccaggaaaggccctggagtggcttggattcatttattggaatgacaataataggaagaggccgtctctggagaccagggtcaccatcaccaaggacaccgccaaaaaccaggtggtctttacactgaccgacatggaccctgtggacacaggcacctattactgtgcacacagaattgcgagtcgtaatggcttgaacctctatattgatgcttttgatttttggggccacgggacaaaggtcactgtctctgcag

SEQ ID NO: 3109 - DNA, 373 bp, Artificial Sequence
  Synthetic construct
cagatcaccttgaaggagtctggtcctacgctggtgaaacccagacagaccctcacgctgacctgcaccttctctgggttctcactcaggactagtggagtgggtgtgggctggatccgtcagcccccaggaaaggccctggagtggctggcactcatttattggaatgatgataagcgctacagcccatctctgaagaccagactcaccatcaccaaggacacctccacaaaccaggtggtccttacattgatcaacatggaccctgtggacacagccacatattactgcgcacacagtcgctattactatactttgggttcctggtactttgactactggggccagggaaccctggtcaccgtctcctcag

SEQ ID NO: 3110 - DNA, 352 bp, Artificial Sequence
  Synthetic construct
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtgttccttacaatgaccaacatggaccctgtggacacagccacatattactgtgcacacaatggcctcccctttgactgctggggccagggaaccctggtcaccgtctcctcag

SEQ ID NO: 3111 - DNA, 379 bp, Artificial Sequence
  Synthetic construct
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttactggaatgatgataagcgctacagcccatctctgaagaacagactcagcatcaccaaggacacctccaaaaatcaggtggtccttacaatgaccaacgtggaccctgtggacacagccacatattactgtgcacaccgaggacgatattgtagtggtaccggctgtgggtactactttgactactggggccagggaaccctggtcaccgtctcctcag

SEQ ID NO: 3112 - DNA, 370 bp, Artificial Sequence
  Synthetic construct
cagatcaccttggaggagtctggtcctgcgctggtgaaacccacacagaccctcacgctgacctgttccttgtctggattctcattcaggtctagtgcagtgggtgtgggctggatccgtcagcccccaggaaaggccctggagtggcttgcattcatttatgggaatgacgataagcgatacagtccgtctctgagggccaggctcaccgtcacgaaggacacctccaaaaaccaggtggtctttagaatgataaacatggaccctgtggacacagccacatatttctgtgcattcagcccgcgaggtgtttattatgaatatttctttgaccactggggccagggaaccctggtcaccgtctcctcag

SEQ ID NO: 3113 - DNA, 361 bp, Artificial Sequence
  Synthetic construct
cagatcaccttgaaggagtctggtcctacgctggtgaaacccacacagaccctcacgctgacctgcaccttctctgggtcctcactcggtactagtggagcgggtgtgggctgggtccgtcagaccccaggaaaggccctggagtggcttgcgctcatttatttgactgatgataaacgttacagcccatctctgaagagcaggctcaccatcaccaaggacacctccaaaaaccaggtggtccttacaatgaccaacatggaccctgtggacacagccagatattactgtgtgtacagtatatatgggtcggggatttttgggtactggggccagggaaccctggtcaccgtctcctcag

SEQ ID NO: 3114 - DNA, 382 bp, Artificial Sequence
  Synthetic construct
cagatcaccttgaaggagtctggtcctacgctggtgaaagccacacagaccctcacgctgacctgcaccttctctgggttctcactcagcactcgtggagtgggtgtgggctgggtccgtcagcccccaggaaaggccctggagtggcttgctctcattaattggaatgatgataagtggtacagcccatctttgaagagcaggctcaccatcaccaaggacacctccaaaaaccaggtggtccttacaatgaccaacatggaccctgtggacacagcaacatattactgtgcacacaacgccaaccgtctgtatttctatgatagtggtcccacattctttgactactggggccagggagccctggtcacggtctcctcag

SEQ ID NO: 3115 - DNA, 376 bp, Artificial Sequence
  Synthetic construct
gaggtgcagttgttggagtcggggggagacttggttcagcctgggagatccctgagactctcgtgttcagcctctggcttcacgtttagcagttatgccgtggggtgggtccgccaggctccagggaagggactggagtgggtctcaagtatcagtgggggtggtcggagtattgtttacgctgactccgtgaagggccggttcaccctctccagagacaattccgagaacacgttgtctctgcaaatgaacagcctgagagtcgaggacacggccctatattactgtacaaaattcgcaacatattactatgatactcctggtcatgaacaccttgactcctggggccggggaacccaggtcaccgtctcctcag

SEQ ID NO: 3116 - DNA, 375 bp, Artificial Sequence
  Synthetic construct
gacgcgggcttggaggagtctgggggaggcttggtacagcctggcgggtccctgagactctcctgtgaaggttctggattcatcctcagtagttttgaggttaattgggtccggcaggctcccgggaaggggctggaatggctttcatatattagtagcagtggtaacactgtgaactacgcagattctgtgaagggccgattcaccatctccagagacaacgccaagaattccgtgtatttgcagctgagcagtctgagagtcgaggatacggctgtttattactgtgcgaggacccttataattggaagtacttatgaacctgaatattacatggacgtctggggcaaaggggccacggtcaccgtctcctca

SEQ ID NO: 3117 - DNA, 349 bp, Artificial Sequence
  Synthetic construct
caggtgcagctgcaggagtcgggcccaggactggtgaagccttcggagaccctgtccctcacctgttctgtctctggtggctccatcagtagtttctactgcagctggatccggcagcccccagggaagggactggagtggattgggtatgtcttttacagtgggaccaccgactacaacccctccctcaagagtcgagtcaccatatcagtagacacgtccaagaaccagttctccctggagctgagctctgtgaccgccgcagacacggccatgtattactgtgcgctcttccctagtggcaactacgactactggggccagggaaccctggtcaccgtctcctcag

SEQ ID NO: 3118 - DNA, 406 bp, Artificial Sequence
  Synthetic construct
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtatattgattatgcagtatctgtgaaaagtcgaataaccatcaacccagacacatccaagaaccagttctccctgcagctgaactctgtgactcccgaggacacggctgtgtattactgtgcaagagatctctgggtagatattatgagtacgtttgggggacgtatcgccatgacggatggggcttttgatatctggggccaagggacaatggtcaccgtctcttcag

SEQ ID NO: 3119 - DNA, 376 bp, Artificial Sequence
  Synthetic construct
caggtgcagctgaaggagtcgggcccaggactggtgaagccttcacagaccctgtccctcacctgcgctgtctctggtggctccgtcagcggtggtgattactcctggaactggatccgacagacaccagggaagggactggagtgggttgggtatatctattacactgggagcacctactacaacccgtccctcaagagtcgaatttccatatcagcagacacggccaagaaccagttctccctggaggtgaagtctgtgaccgccgcggacacggccgtgtattactgcgccagcggatattgtagcggtggaagatgctacggggaattcctccagcactggggccagggcaccctggtcaccgtctcctcag

SEQ ID NO: 3120 - DNA, 379 bp, Artificial Sequence
  Synthetic construct
caggtgcagctgcaggagtcgggcccaggactggtgaagccttcggagaccctgtccctcatctgcactgtctctggtggctccatcagtactcaatactggaactggatccgacagcccccagggaagggactggagtggattgggtacatctcttacagcgggagtaccaattacaatccctccctccagagtcgagccaccatatcactagacacgaccaacaaccagttctccctgaagttgagctctgtgaccgctgcggacacggccgtatattactgtgcgcgagataaaagggaggtattggttttcagagcaggcactggttcgggattcgacccctggggccagggaaccctggtcaccgtctcctcag

SEQ ID NO: 3121 - DNA, 372 bp, Artificial Sequence
  Synthetic construct
caggtgcagctacaacagtggggcgcaggactgctgaagccttcggagaccctgtccctcacctgcgctgtctatggtgagtctttcagtgcttacttctggaactggatccgccaacccccaggggaggggctggagtggattggaaaaatcaatgatggcggaagcacgaagtataacccgtcactcaagagtcgagtcagcatttcagtagacacgtccaagaggcagatctccctcaaagtgatttctgtgaccgccgcggacacggctatatattattgttcgagagggaccaaggggggggtcagcccacactcctactactacgtggacgtctggggcaatgggaccacggtcaccgtctcctca

SEQ ID NO: 3122 - DNA, 372 bp, Artificial Sequence
  Synthetic construct
caggtgcagctacaacagtggggcgcaggactgctgaagctttcggagaccctgtccctcacctgcgctgtctatggtgagtctttcagtgcttacttctggaactggatccgccaacccccaggggaggggctggagtggattggaaaaatcaatgatggcggaagcacgaagtataacccgtcactcaagagtcgagtcagcatttcagtagacacgtccaagaggcagatctccctcaaagtgatttctgtgaccgccgcggacacggctatatattattgttcgagagggaccaaggggggggtcagcccacactcctactactacgtggacgtctggggcaatgggaccacggtcaccgtctcctca

SEQ ID NO: 3123 - DNA, 355 bp, Artificial Sequence
  Synthetic construct
caggtgcagctacagcagtggggcgcaggactgttgaagccttcggagaccctgtccctcacctgcactgtttctggtggctccatcagtacttactactggaactggatccggcaacccccagggaagcgactggagtggattgggcacatctttcacagtgggaccaccagctacgacccctccctcaagagtcgagtctccatgtcagtagacacgtccaggaatcagttctccctgaaactgacctctgtgaccgctgctgacacggccgtttattactgtgcgagagccctgtatgacagcaacccgtttgactactggggccagggaaccctggtcactgtctcctctg

SEQ ID NO: 3124 - DNA, 361 bp, Artificial Sequence
  Synthetic construct
cacgtgcagctgcaagaatcgggcccaggactggtgaagccttcggagaccctgtccctcacctgcactgtctctggtgactccatcactaataactactggaactggatccggcagcccccagggaagggactggagtgggttgggtatatctattatagtgggaccaccaagtacggcccctccctcaagagtcgagtcaccatgtcagtagacacttccaagaaccagttctccctgacactgacctctgtgaccgctgcggacacggccatatattactgtgcgagagcccgccattattatgggtcggggagttttgactcctggagcccgggaaccctggtcaccgtctcctcag

SEQ ID NO: 3125 - DNA, 388 bp, Artificial Sequence
  Synthetic construct
caggtgcagctgcaggagtcgggcccaggactggtgaaggcttcacagaccctgtccctcacctgcactgtctctggtgactccatcagcagtagtacttattactggaactggatccggcagtccgccgggaagggactggagtggattgggcgtatccaaagtggtggaaccaccaactacaatccctccctcaagaggcgagtctccatatcagtagacacataccagaaccaattctccctgaaactgagttctgtgaccgccgcagacacggccgtatattactgtgcgagttcgttaattcggccatattgtgatggtggtgcctgctactcgaattgggtcgacccctggggccagggaaccctggtcaccgtctcctcag

SEQ ID NO: 3126 - DNA, 361 bp, Artificial Sequence
  Synthetic construct
caggtgcagctgcaggagtcgggcccaggactggtgaagccttcacagaccctgtccctcacctgcagtctctctggtgactccatgaacaggagtggttactactggaactggatgcggcagcccgccgggaagggactggagtggattgggcggatctataccaatgggggcaccaattacaacccttccctcacgagtcgagtctccatgtcaatagagacgtccaagaaccagttctccttgaggctgacctctgtgaccgccgcagacacggccgtatatttctgtgcgaggtcgagagatggctacaactccctttatatctggggccaagggacaatggtcaccgtctcttcag

SEQ ID NO: 3127 - DNA, 379 bp, Artificial Sequence
  Synthetic construct
caggtgcaactgcaggagtcgggcccaggactggtgaagtcttcagagaccctgtccctcacttgcactgtctctggtggctccttcagcagtggtagttactactggaactgggtccggcagcccgccgggaaggggctggagtggattgggcgtatctatagaagtggatacactaactacagcccctccctcttgagtcgagtcaccatatcagtggacacgtccaggaaccacctctccctgaggctgagctctgtgaccgccgcagacacggccgtgtattactgtgcgagagagtcgaacgagcttcggagtgcttatcacccctatcactttgactactggggccagggatccctggtcaccgtctcctcag

SEQ ID NO: 3128 - DNA, 376 bp, Artificial Sequence
  Synthetic construct
caggtgcagctgcaggagtcgggcccaggactggtgaagccttcacagaccctctccctcacctgcactgtctctggtggctccatcagcagtggtagttattactggaactgggtccggcagcccgccgggaggggactggagtggattgggcgtatctataccagtgggatcaccgaatacaacccctccctcaagagtcgagtcaccatatcagtagacccgtccaagaaccacttctctttgaagctgacctctgtgaccgcctcagacacggccgtgtattactgtgcgagagattcccacctggttcggggagtcgagtctcccgaatctgactactggggccagggaaccctggtcaccgtctcctcag

SEQ ID NO: 3129 - DNA, 357 bp, Artificial Sequence
  Synthetic construct
caggtgcagctgcaggagtcgggcccaggactggtgaagccctcggagaccctgtcactcacgtgcagtgtctctggaggctccatcagtggctactactggaactgggtgcggcagtccccagggaagggactggagtggattgggtatatccgctacagtggcgccacctactacaacccctccctcaggagtcgagtcaccatgtcagttgacacgtccaagaatcagttctccctgaatctgagttctgtgaccgctgcggacacggccgtctattactgtgcgagacagatgggagattattactactatatggacgtctggggcgaagggaccgcggtcaaggtctcctca

SEQ ID NO: 3130 - DNA, 355 bp, Artificial Sequence
  Synthetic construct
caggtgcagctgcaggcgtcgggcccaggactggtgaagccttcggagaccctgtccctcacctgcagtgtgtcaggtgactccatcactagttactactggaattggatccggcaggccccagggagagaattggagtgggttggatatgtctattacaatgagagcatcaactacaacccctccctcaagagtcgagtcgccatatcagtagacacgtccaggagccagttttccctgaaacttacttctgtgaccgctgcggacacggccgtgtatttctgtgcgagatcaatctggcaaccggaatactttgactactggagccagggaaccctggtcaccgtctcctcag

SEQ ID NO: 3131 - DNA, 364 bp, Artificial Sequence
  Synthetic construct
caggtgaaattgcaggagtcgggcccaggagtggtgaagccttcggagaccctgtccctcacctgcactgtccccggggactccaccagaagttattattggacatggattcggcagcccccagggaagggactggagtggattggacgtatccattatagtggcaacttcaactacaacccctccctcaagagtcgagtctccatatcactggacgagtccaggaaccagttctccctgaagctgacctctatgaccgctgcggacacggccatatattattgtgcggggctgagttattatgacaattttggctctcaaaatgactactggggccagggaaccctggtcaccgtctcctcag

SEQ ID NO: 3132 - DNA, 358 bp, Artificial Sequence
  Synthetic construct
caggtgcagctactcgagtcgggcccaggactggtgaagccttcggggaccctgtccctcgcctgcagtgtctctagtgtctccctgaatgattattattggacctggatccgacagtcccccgggaagggactggaatggattggccatatcttttacagtgggaccaccaattacaactccgccctcaagagtcgagtctccatgtccctggacacgtccaagaaccagttctccctgaggctgacgtctgtgaccgctgcggacacggccgtctactactgttcgacatcaaagtactacgacaccttacacctctcttcctggggccagggagccctggtcaccgtctcctccg

SEQ ID NO: 3133 - DNA, 372 bp, Artificial Sequence
  Synthetic construct
caggtgcagctacagcagtggggcgcaggactgttgaagccttcggagaccctgtccctcacctgcggtgtttatggtgggtccttcagtggttactactggacctggatccgccagcccccagggaaggggctggagtggattggggaaatcaatcatagaggaagcacctacaacccgtccctcaagagtcgagtcaccatatcaatagacacgtccaagaaccaggtctccctgaaattgagctctgtgaacgccgcggacacggctgtgtattactgtgcgagagttattactagggcgagtcctggcacagacgggaggtaccgtatggacgtctggggccaagggaccacggtcaccgtctcctca

SEQ ID NO: 3134 - DNA, 352 bp, Artificial Sequence
  Synthetic construct
caggtgcagctgcaggagtcgggcccaggactggtgaagccttcggagaccctgtccctcacctgcactgtctctggtggctccatcaatacttactactggacctggatccggcagcccccagggaagggactggagtggattgggtatatctattacagtgggagcaccaactacaacccctccctcaagagtcgagtcaccatatcaatagacacgtccaagaaccagttctccctgaagctgagctctgtgaccgctgcggacacggccgtgtattactgtgcgagagagggtccggggcggggccttgactactggggccagggaaccctggtcaccgtctcctcag

SEQ ID NO: 3135 - DNA, 355 bp, Artificial Sequence
  Synthetic construct
caggtgcagctgcaggagtcgggcccaggactggtgaagccttcggagaccctgtccctcacctgcactgtctctggtggctccatcagtagttactactggacctggatccggcagcccccagggaagggactggagtggattgggtatatctattacagtgggagcaccaactacaatccctccctcaagagtcgagtcaccatagcagtagacacgtccaagaaccagttctccctgaagctgacctctgtgaccgctgcggacacggccgtgtattactgtgcgagagattccctccagtatagggcttttgatatctggggccaagggacaatggtcaccgtctcttcag

SEQ ID NO: 3136 - DNA, 384 bp, Artificial Sequence
  Synthetic construct
caggtgcagctgcaggagtcgggcccaggactggtgaagccttcggagaccctgtccctcgcctgcagtgtctctggtgactccatcagtacttactactggacctggatccggcagcccccagggaagggactggagtggattggttatatctattacagtgggagcaccaactacaacccctcactcaagggtcgagtcaccttatcagtagacacgtccaagaaccagttctccctgaagctgagctctgtgaccgctgcggacacggccgtgtattactgtgcgagagggaatttagttcaatattttgactggtcccaagactactactactactacatggacgtctggggcaaagggaccacggtcaccgtctcctca

SEQ ID NO: 3137 - DNA, 366 bp, Artificial Sequence
  Synthetic construct
caggtgcagctgcaggagtcgggccccggactggtgaggccttcggagaccctgtccctcacctgctctgtctctggtgcctccatcaattatttctactggacctggatccggcagcccgccggaaagggactggagtggattgggcgtatctattcgaatgggacctccacctacaattcctccctcaggagtcgagtcaccatgtcagtagacacgtccaagaaccagttctccctgaagctgacctctgtgaccgccgcggacacggccgtctattactgtgcgagagacatgtacaggatctacttctactactactacatggacgtctggggcaaagggaccacggtcaccgtctcctca

SEQ ID NO: 3138 - DNA, 376 bp, Artificial Sequence
  Synthetic construct
caggtgcagctgcaggagtcgggcccaggactggtgaagtcttcacagaccctgtccctcacctgcactgtctccggtgactcaatcagcagtggtttttatcactggacctggatccggcagcccgccggaaagggactggagtggattggtcgtattcctactactgggagtagttcctataacccgtccctcacgagtcgagtcagtctgtcactagataagtccaagaaccagttctccctggatctgacctctgtgaccgcctctgacacgggcgtctattactgcgcgagaaatgttggcatttgcagtagtggcagctgccccccgtttgactcctggggcccgggactcttggtcaccgtctccgcag

SEQ ID NO: 3139 - DNA, 385 bp, Artificial Sequence
  Synthetic construct
caggtgcagctgcaggagtcgggcccaggactggtgaagccttcacagaccctgtccctcacctgcactgtctctggtggctccatcagcagtggtagttactactggacctggatccggcagcccgccgggaagggactggagtggattgggcgtatctataccagtgggagcaccaactataacccctccctcaagagtcgagtcaccatatcagtagacacgtccaagaaccagttctccctgaagctgagctctgtgaccgccgcagacacggccgtgtattactgtgcgagagaggggacgtattactatgatagtagtggttattactacaactggttcgacccctggggccagggaaccctggtcaccgtctcctcag

SEQ ID NO: 3140 - DNA, 367 bp, Artificial Sequence
  Synthetic construct
caggtgcagctgcaggagtcgggcccaggactggtgcagccatcacagaccctgtccctcacctgcactgtctctggtggctccatcagcagtagtaactactactggacctggatccggcagcccgccgggaagggattggagtggattgggcgtatcgctgccagtggcagctcgaattacaacccctccctcaggagtcgagtcaccatatcaatagataggtccaagagccagttctccctgaagttaaactctgtgaccgccgcggacacggccgtgtatttctgtgtgagggaacgtactatggatccgggagtcccctttgactactggggccagggaaccctggtcaccgtctcctcag

SEQ ID NO: 3141 - DNA, 370 bp, Artificial Sequence
  Synthetic construct
caggtgcagctgcaggagtcgggcccaggactggtgaagccttcacagaccctgtccctcacctgcactgtctctgggggctccatcaggggtgataattactactggacctggatccggcagcccgccgggaggggcctggagtggattgggcgcatccatatcagtgggaacaccaactacaattcctccctcaagagtcgagtcaccatatcactagacacgtccaagagccagttctccctgaagctgaggtctctgaccgccgcagacacggccgtctattactgtgcgagagaggtggataaagctctggtcggagagctttttgactcctggggccagggaaccctggttagcgtctcctcag

SEQ ID NO: 3142 - DNA, 364 bp, Artificial Sequence
  Synthetic construct
cgggtgcagctgcaggagtcgggcccaggagtggtgaagtcttcggagaccctgtccctcacctgcagtgtctctggcgcctccatgactagttactactggacctggatccggcagtccccagggaagggactggagtggattggacatatccattacagtggcggcaccaactccaacccctccctccggagtcgagtcaccatatcactagacgagtccgggaaccagttttccctgaggttaaactctgcgaccgctgcggacgcggccatttattactgtgtgggactgtacttttatgacaacagcggcaccgaaaatgactgttggggccagggaaccctggtcaccgtctcctcag

SEQ ID NO: 3143 - DNA, 364 bp, Artificial Sequence
  Synthetic construct
caggtgcagctgcaggagtcgggcccaggactggtgaggcctggggagaccctgtccctcacctgcactgtctctggtggctccatgagtagttactactggacctggatccggcagtccccagggaagggactggagtggattgggcatatctattacaatgggaacacccagtacaacccctccctccagagtcgagtcaccctttcagtagacacgtccaagaaccagttctccctgcagctgagctctgtgaccgccgcagacacggccgtgtattactgtatgcgacgcgtggtggtgattgatactagggattcttttgacatgtggggccaagggacaatggtcaccgtctcttcag

SEQ ID NO: 3144 - DNA, 385 bp, Artificial Sequence
  Synthetic construct
caggtacagctgcaggagtcgggcccagggctggtgaagccttcacagaccctgtccctcacctgcactgtctctggtggctccatcagcagtgggagtcactactggacctggattcggcagcccgccgggaagggactggagtggattggacatatttttatcagtgggagcaccacctacagcccgtcccccaagagccgagtcaccgtatcagcagacacgtccaagaatcagttctccctgaagctgagttctgtgaccgccgcagacacggccgtgtattactgtgcgagagccgaggcgtattacgataatttgcccggttattatgcaagtgcgtttgatatatggggccaagggacaatggtcaccgtctcttcag

SEQ ID NO: 3145 - DNA, 388 bp, Artificial Sequence
  Synthetic construct
caggtgcagctgcaggagtcgggcccgggactggtgaggccctcagagaccctgtccctcatgtgctcggtctcgggtgcctctctcacgaacccgtctttttactggacctggcttcgacagcccgccggggggcggctggagtggattgggcgtttgtatagtagcggcaatggtcactacaatccctccctgaagaatcgggcctccgtgtcactggacacctccaggaattcattttccttgcgcctgacgtcagtgaccgccgcagactcggccatttattactgcgcggcaacgattttggctaattatgatgtcgtttttgggagtgatcgccgctcctttgacttctggagcccgggatcgtgggtcaccatctcctcag

SEQ ID NO: 3146 - DNA, 402 bp, Artificial Sequence
  Synthetic construct
caggtgcagctacagcagtggggcgcaggtctgttgaagccttcggagaccctgtccctcacctgcgctgtctatggtgattccttcagtgattactactggacctgggtccgccagttcccagggaaggggctggagtggattggcgaaatcaatcataatggagccacccacgacaacccgtccctccagagtcgagtcaccatgtcagtggacacgtacaagcagcaattctccctgacactgacgtctctgaccgccgcggacacggctgtctactactgtgcgcgcgtggcagcctatcacaatgcttcggggagtttccgtcctagtgggcgctcctactccttcttctactacatggacgtctggggcaaagggaccacggtcaccgtctcctca

SEQ ID NO: 3147 - DNA, 364 bp, Artificial Sequence
  Synthetic construct
caggtgcagctacagcagtggggcgcaggactgttgaagccttcggagaccctgtccctcacctgcgctgtctctggtgggtccttcagaggtttcttctggacgtggatccgccagcccccaggaaagggcctggagtggattggggaaatcgatcatagtggcagcaccaactacaggccgtcgctcaagagtcgagtcatcatatcaggagacacgtccaagaagcagttctccctgaggctgccctctgtgaccgccgcggacacggctgtatattactgtgcgagaggccgggggccattgagggggggaagctggttcgactcctggggccagggaaccctggtcaccgtctactcag

SEQ ID NO: 3148 - DNA, 373 bp, Artificial Sequence
  Synthetic construct
caggagcaattacagcagtggggcgcaggactgttgaagccttcggagaccctgtccctcacctgcgctgcctatggtgcgtccttcaacatttattcttggacttggatccgccagcccccagggaaggggctggagtggattggggatatcaatcatcgtggaagcaccaactacaacccgtccctcaagagccgagtcaccatatcagcagacacgtccaagaaccagttctccctgacattgaggtctgtgaccgccgcggacacggcgatgtattactgtacgagaggccccagaaagtggctacaacaccaatctcgggggggctttgacatctggggccagggaaccctcgtcagcgtctcctcag

SEQ ID NO: 3149 - DNA, 367 bp, Artificial Sequence
  Synthetic construct
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaaagggaacttatagcagtggctggtacgatgcttttgatatctggggccaagggacaatggtcaccgtctcttcag

SEQ ID NO: 3150 - DNA, 370 bp, Artificial Sequence
  Synthetic construct
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcgcccccaccgttcggggagttattaccaactggttcgacccctggggccagggaaccctggtcaccgtctcctcag

SEQ ID NO: 3151 - DNA, 381 bp, Artificial Sequence
  Synthetic construct
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcgtaagatggatggttcggggcggccggtcttactactactactacatggacgtctggggcaaagggaccacggtcaccgtctcctca

SEQ ID NO: 3152 - DNA, 375 bp, Artificial Sequence
  Synthetic construct
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacagcccgtccctcaagagtcgagtcaccatatcagtagacacgtccaaaaaccagttctccctgaagctgagctctgtgaccgccgcggacacggctgtgtattactgtgcgagaggctactatagggtgtggaattactatggttcgggcaactacacggacgtctggggcaaagggaccacggtcaccgtctcctca

SEQ ID NO: 3153 - DNA, 373 bp, Artificial Sequence
  Synthetic construct
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggctgggcccactatagggttcggggagctaagcgttattttgactactggggccagggaaccctggtcaccgtctcctcag

SEQ ID NO: 3154 - DNA, 370 bp, Artificial Sequence
  Synthetic construct
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggggccggattgtagtagtaccagctgctagctactttgactactggggccagggaaccctggtcaccgtctcctcag

SEQ ID NO: 3155 - DNA, 361 bp, Artificial Sequence
  Synthetic construct
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcactagacacgtccaagaaccagttctccctgaagctgagctctgtgaccgccgcggacacggctgtgtattactgtgcgagattatcatttggttcgggggatgatgcttttgatatctggggccaagggacaatggtcaccgtctcttcag

SEQ ID NO: 3156 - DNA, 375 bp, Artificial Sequence
  Synthetic construct
caggtgcaggtacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaggcaccaactacatcccgtccctcaagagtcgagtcaccatatcagtagacacgtccaagaaccagttctccctgaagctgagctctgtgaccgccgcggacacggctgtgtattactgtacgagaggccttagagcagtggttggtacttcctacaactactactacatggacgtctggggcaaagggaccacggtcaccgtctcctca

SEQ ID NO: 3157 - DNA, 396 bp, Artificial Sequence
  Synthetic construct
caggtgcagctgcagcagtggggcgcaggcctgttgaagccttcggagaccctgtcactcacctgcgctgtctatcgtgggtcgttaagtgctcactattggagctggatccgccagcccccagggaaggggctggagtgggtcggggatatcagtcatggtggaggcaccaactacaatccgtccctcaagaatcgagtcaccatctcactagacaagtccaagaaccaattctccctcaaaatgacctctgtgaccgccgcggacacggctatctattactgtgcgagagtccttggggaggcggaatccgattatttgactggttctcatcttcgttactactactactacatggacgtctggggcacagggaccacggtcaccgtctcctca

SEQ ID NO: 3158 - DNA, 361 bp, Artificial Sequence
  Synthetic construct
caggtgcggcttcagcagtggggcgcaggactgttgaagccttcggagaccctgtccctcacctgcgctgtctatggtgggtccttcaatgattactactggagctggatccgccagcccccaggtaaggggctggagtggattggggaaatcaatcaaagtggaagcaccaaatacaacccgtccctcaagagtcgagtcaccacttcagtagacacgtctaagaatcaattctccctgaaactgaggtctctgaccgccgcggacacggctgtttattactgtgcgagaggccttgggaagcagtggttcagctgcttcgacccctggagccagggaaccctggtcatcgtctcctcag

SEQ ID NO: 3159 - DNA, 352 bp, Artificial Sequence
  Synthetic construct
caggtgcagctacagcagtggggcccaggactgttgaagccttcggagaccctgtccctcacctgcgctgtttcttatgggtccttcagtggttactcctggagctggatccgccagccccccgggaaggggctggagtggattggggaaatcaatcatagtggaagcaccaactacaacccgtccctccagagtcgagtcaccatatcagcagacacgtccaagagccaattctccctgaatctgaggtctgtgaccgccgcggacacggctgtttattactgtgcgagagttactaacagaggctggtatagggcctggggccagggaaccctggtcaccgtctcctcag

SEQ ID NO: 3160 - DNA, 385 bp, Artificial Sequence
  Synthetic construct
caagtacagctacaacagtggggcgcaggactgttgaagccttcggagaccctgtctctcatctgtgctgtctatcgtgggtccttcagagatcactactggagctggatccgccagtccccagggaaggggctggagtggattggggaaatcaatcatactggaagcaccaactccaacccgtccctcaagagtcgagtcaccatgtcagtagacacgtccaagaaccagttctccctgaagctgagctctgtgaccgccgcggacacggctgtctattactgtgcgagagggggagcctattccgatttttggagtggctttccaaatgcccgagccttctttgactcctggggccagggaaccttggtcaccgtctcctcag

SEQ ID NO: 3161 - DNA, 378 bp, Artificial Sequence
  Synthetic construct
caggtgcagctccaacaatggggcgcaagactgttgaagccttcggagaccctgtccctcacctgcgctgtctatggtgggtccttcagtggttacttctggagctggatccgccagtccccagggaaggggctggagtggattggggaaatcaatcatagtggaaccaccaattacaacccgtccctcaagagtcgagtcaccatttcagtcgacacgtccaagaatcagttctccctgaagttgacttctgtcaccgccgcggacacggctgtttattattgttcgagaggaaatgccgggatagccggtcatatttttcacttcctctactacatcgacgtctggggcgatgggaccacggtcaccgtctcctca

SEQ ID NO: 3162 - DNA, 357 bp, Artificial Sequence
  Synthetic construct
caggtgcagctgcaggagtcgggcccaggactggtgaagccttcggagaccctgtccctcacctgcactgtctctggtggctccatcagcaacttctactggagctggatccggcaagccccagggaagggactggagtggattggatatatctataacactgggaccaccaactacaacccctccctcaagagtcgagtcaccatttcattagacacgtccaggaaccagttctccctgaggctgaggtctgtgaccgctgcggacacggccgtctattactgtgcgagagatggcccgggaaagaactacttcttggacgtctggggcagagggaccacggtcatcgtctcctca

SEQ ID NO: 3163 - DNA, 367 bp, Artificial Sequence
  Synthetic construct
caggtgcagctgcaggagtcgggcccaggactggtgaagccttcacagaccctgttcctcacctgcgatgtctctggtgactccatcagcagtggtggttactcctggagctggatccggcagccaccagggaagggactggagtggattgggtatatctcttatactgggagcaccgactacaacccgtccctcaagagtcgagttaccatatcaggagacacgtccaggaaccagttctccctgaagctgacctctgtgaccgccgcggacacggccgtgtattactgtgccagagtctacaatggagatggcaacaaccccattgactactggggccagggaaccctggtcaccgtctcctcag

SEQ ID NO: 3164 - DNA, 384 bp, Artificial Sequence
  Synthetic construct
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattattgtgccagagggtccctggatgatgatagtagtggttattactcctactactatatggacgtctggggcaaagggaccacggtcaccgtctcctca

SEQ ID NO: 3165 - DNA, 370 bp, Artificial Sequence
  Synthetic construct
caggtgcagctgcaggagtcgggcccgggactggtgaagccttcacagaccctgtccctcacctgctctgtctctggtgactccgtcaacagtggtgcttactcctggagctggatccggcagccaccagggcagggactggagtggattggagatatcttttacagtgggagtgcctattacaacccgtccctcaagagtcgatttaccatgtcaatagacacggccaagaatcagttctccctgaacctgaactctgtgaccgccgcggacacggccgtctattactgtgccagagccaagggagatggctacattgggggcatttttgactcctggggccagggaacccgggtcaccgtctcctcgg

SEQ ID NO: 3166 - DNA, 370 bp, Artificial Sequence
  Synthetic construct
caggtgcacctgcaggagtcgggcccaggactggtgaagccctcggcgaccctgtccctcacctgcaatgtctctggtggctccatcaggagtcactactggagctggatccggcagcccccagggaagggactggaatggattggatatgtttattatactgggaccaccgactacagcccctccctcaagagtcgagccaccatatcaattgacccatcgaagagtcagtttttcctgaagttgaggtctgtgaccgccgctgacacggccgtatattactgtgcgagactgaattactatgatcgtaatggtcattactattactttgactactggggccaaggaggcctggtgaccgtcccctcag

SEQ ID NO: 3167 - DNA, 364 bp, Artificial Sequence
  Synthetic construct
caggtgcagctgcaggagtcgggcccaggactggtgaagccttcggagaccctgtccctcacctgcactgtctctggtgactccatcagtggttaccactggagctggatccggcagcccccagggaagggactggagtggatcgggtatatctattacagtgggagcaccaagtacaacccctccctcaagagtcgaggcaccatatcagtagacacgtccaaaaaccagttctccctgaagctgagctctgtgaccgctgcggacacggccgtgtatttctgtgcgagaaacttcggtgactacgcctacccctacttctttgacttctggggccagggaaccctggtcaccgtctcctcag

SEQ ID NO: 3168 - DNA, 366 bp, Artificial Sequence
  Synthetic construct
caggtgcagctgcaggagtcgggcccaggactggtgaagccttcggagaccctgtctctcacctgcagtgtctctggtggctccaccaggagttactactggagctggatccggcagcccccagggaagggactggagtggattggatatagttataacaatgagagaacgaagtacgacccctccctcacgagtcgagtcaccatatcagtggacacgtccaagaaccagattaccctgaacctgacctctgtgaccgccgcggacacggccgtgtattattgtgcgagaggtattattttgagtgggtcccccctctactacctggacgtctggggcaaagggaccacggtcaccgtctcctca

SEQ ID NO: 3169 - DNA, 354 bp, Artificial Sequence
  Synthetic construct
caggtgcacctgcaggagtcgggcccaggactggtgaagccttcggagaccctgtccctcacctgcactgtctctgatggctccatcaatagttactactggagctggatccggcagcccccagggaagggactggagtggattgggtatatctattacagtgggagcgccaactacaacccctccctcaagagtcgagtcaccatttcattagacacgtccaacaaccagttctccctgaagctgagctctgtgaccgccgcagacacggccgtttattactgtgcgagattcgcccgactagactactacatggacgtctggggcaaagggaccacggtcaccgtctcctca

SEQ ID NO: 3170 - DNA, 381 bp, Artificial Sequence
  Synthetic construct
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgccgcagacacggccgtgtattactgtgcccgactttactggggttgtactaatggtgtatgctcctactactactactacatggacgtctggggcaaagggaccacggtcaccgtctcctca

SEQ ID NO: 3171 - DNA, 375 bp, Artificial Sequence
  Synthetic construct
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaatcccgaccccgaatgtgggatatacagctgggtactactacatggacgtctggggcaaagggaccacggtcaccgtctcctca

SEQ ID NO: 3172 - DNA, 358 bp, Artificial Sequence
  Synthetic construct
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccgactacaacccctccctcaagagtcgagtcaccatatcagtagacacgtccaagaaccagttctccctgaagctgagctctgtgaccgctgcggacacggccgtgtattactgtgcgagagaaaggcatgactacgtaggagcttttgatatctggggccaagggacaatggtcaccgtctcttcag

SEQ ID NO: 3173 - DNA, 373 bp, Artificial Sequence
  Synthetic construct
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagaaggaagcagcagctggtacacgacctggggatgggcttttgatatctggggccaagggacaatggtcaccgtctcttcag

SEQ ID NO: 3174 - DNA, 358 bp, Artificial Sequence
  Synthetic construct
caggtgcagctgcaggagtcgggcccaggactggtgaagccttcggagaccctgtccctcacctgcactgtctctggtggctccatcaatacttactactggagctggatccggcagcccccagggaagggactggagtggattgggtatatctattacagtgggagttccaactataacccctccctcaagagtcgagtcaccatatcagtagacacgtccaagaaccagttctccctgaagctgagctctgtgaccgctgcggacacggccgtgtattactgtgcgagagataatcagattactaaggatgcttttgatatctggggccaagggacaatggtcaccgtctcttcag

SEQ ID NO: 3175 - DNA, 369 bp, Artificial Sequence
  Synthetic construct
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcggagctatagtggctactactactactactacatggacgtctggggcaaagggaccacggtcaccgtctcctca

SEQ ID NO: 3176 - DNA, 349 bp, Artificial Sequence
  Synthetic construct
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagcggtattggtgactactttgactactggggccagggaaccctggtcaccgtctcctcag

SEQ ID NO: 3177 - DNA, 373 bp, Artificial Sequence
  Synthetic construct
caggtgcagctgcaggagtcgggcccaggactggtgaagccttcggagaccctgtccctcacctgcactgtctctggtggctccatcagtggttactactggagctggatccggcagccccccgggaagggactggagtggattgggaatatctactacagtgggagcaccaactacaacccctccctcaagaatcgattcaccatatcagtagacacgtccaagaaccagttctccctgaaggtgacctctgtgaccgccgcagacacggccgtgtattactgtgcgagacgacattcggagcagtggctgttaaggggccctggtgcttttgatatctggggccaagggacaatggtcaccgtctcttcag

SEQ ID NO: 3178 - DNA, 361 bp, Artificial Sequence
  Synthetic construct
caggtgcagctgcaggagtcgggcccgggactggtgaagccttcggagaccctgtccctcacctgcactgtctctggtggctccatcagtagttactactggagctggatccggcagccccccgggaagggactggagtggattgggtatatctattacagtgggggcaccaagtacaacccctccctcaagagtcgagtcaccatatcagtagacacgtccaagaaccagttctccctgattctgagctctgtgaccgctgcggacacggccgtgtattattgtgcgagagggtcggaatggcgtctctattactactttgactactggggccagggaaccctgctcaccgtctcctcag

SEQ ID NO: 3179 - DNA, 364 bp, Artificial Sequence
  Synthetic construct
caggtgcagctgcaggagtcgggcccaggactggtgaagccttcggagaccctgtccctcacctgcactgtctctggtgactccatcagtaattactactggagctggatccggcagccccctgggaagggactggagtggattgggtatatctataacagtgcgaacaccaactacaacccctccctcaagagtcgagtcaccatttcagtagacacgtccaaaaaccagttctccctgaggctgacctctgtgaccgctgcggacacggccgtgtattattgtgcgagacgggtggtggtagatcctactctcgggtcatttgatatctggggccaagggacattggtcaccgtctcctcag

SEQ ID NO: 3180 - DNA, 355 bp, Artificial Sequence
  Synthetic construct
caggtgcaactactggagtcgggcccaggactggtgaagccttcacagaccctgtccctcacctgcaatgtctctggtggctccatcaacagcggtaattactactggagctggatccggcagcccgccgggaagggactggagtggattggacgaatcgaaaccagtgggagcaccaactacaatccctccctcaagagtcgagtcaccatatcagtagacatgtccaagaaccagttctccctgaagatgagctctgtgaccgccgaagacacggccgtgtattattgtgcgagagatcgcaggggatacagcttttactggggccagggaaccctggtcaccgtctcctcag

SEQ ID NO: 3181 - DNA, 382 bp, Artificial Sequence
  Synthetic construct
caggtgcagctgcaggagtcggggccaggactggtgaagccttcacagaccctgtccctcacttgcactgtctctggtgactccgtcagcagtggtacttactcctggagctggatccggcagcccgccgggaagggactggagtggattgggcgcatgtacaccagtgggcgcaccgaccacaacccctccctcaagaggggagtcaccatatcagtggacacgtccaagaaccagttctccttgaggctgacttctgtgaccgccgcagacacggccgtctattactgtgcgagagagttttattactctgatagtaatgattttccatttcatgtttttgatatctggggccacgggacactggtcaccgtctcttcag

SEQ ID NO: 3182 - DNA, 358 bp, Artificial Sequence
  Synthetic construct
caggtgcagctgcaggagtcgggcccaggactggtgaagccttcacagaccctgtccctcacctgcactgtctctggtggctccatcagcagtggcagttactactggagctggatccggcagcccgccgggaagggactggagtggattgggcgtatctataccagtgagagcaccaactacaacccctccctcaagagtcgagtcaccatatcagtagacacgtccaagaaccagttctccctgaggctgacctctgtgaccgccgcagacacggccgtgtattactgtgcgagagagggtataggcggagctactgatatctggggccaagggacaatggtcaccgtctcttcag

SEQ ID NO: 3183 - DNA, 376 bp, Artificial Sequence
  Synthetic construct
caggtgcagctgcaggagtcgggcccaggactggtgaagccttcacagaccctgtccctcacctgcactgtctctggtggctccatcagaagtgatagttcctactggagctggatccggcagcccgccgggaagggactggagtggattgggcgtatctataccagtgggagcaccaactacaacccctccctcaagagtcgagtcaccatatcaatagacacgtccaagaaccagttctccctgaagatgagctctgtgaccgccgcagacacggccgtgtattactgtgcgagagatctcggctacggtggtaactccccccactggtacttcgatctctggggccgtggcaccctggtcactgtctcctcag

SEQ ID NO: 3184 - DNA, 367 bp, Artificial Sequence
  Synthetic construct
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccacttctccctgaagctgagctctgtgaccgccgcagacacggccgtctattactgtgcgagagcggactacggtgactacgaggactactttgactactggggccagggaaccctggtcaccgtctcctcag

SEQ ID NO: 3185 - DNA, 358 bp, Artificial Sequence
  Synthetic construct
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagaggcggcggaggggggtggttcgacccctggggccagggaaccctggtcaccgtctcctcag

SEQ ID NO: 3186 - DNA, 373 bp, Artificial Sequence
  Synthetic construct
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagagggggactctatggttcggggagagtaaactggttcgacccctggggccagggaaccctggtcaccgtctcctcag

SEQ ID NO: 3187 - DNA, 361 bp, Artificial Sequence
  Synthetic construct
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagatcccgttcgaggcagcagccaaatgactactggggccagggaaccctggtcaccgtctcctcag

SEQ ID NO: 3188 - DNA, 361 bp, Artificial Sequence
  Synthetic construct
caggtgcagctgcaggagtcgggcccaggactggtgaagccttcggagaccctgtccctcacctgcactgtctctggtggctccatcagtacttactactggagctggatccggcagcccgccgggaagggactggagtggattgggcgtatctctaccagtgggagcaccaactacaacccctccctcaagagtcgagtcaccatgtcagtagacacgtccaagaaccagttctccctgaagctgagctctgtgaccgccgcggacacggccgtgtatttctgtgcgagagatcgtaagggtagtgacggtgatagcatggacgtctggggcaaagggaccacggtcaccgtctcctcag

SEQ ID NO: 3189 - DNA, 376 bp, Artificial Sequence
  Synthetic construct
caggtgcagctgcaggagtcgggcccaggactggtgaagccttcggagaccctgtccctcacctgcagtgtctctggtggttccataagaaattattactggagctggatccggcagcccgccgggaagggtctggagtggattggccgtatctacaccagtgggaccaccgactacaacccctccctttcaaatcgagtcaccatgtcggtggacacgtccaagaatcagttctccctgacggtggactctgtgaccgcagcagacacggccgtctatttctgtgcgagggcccgacaccgatactacgattctttgactggccaggggtcctttgattactggggccagggaatactggtcaccgtctcctcag

SEQ ID NO: 3190 - DNA, 355 bp, Artificial Sequence
  Synthetic construct
caagtgcagctgcaggagtcgggcccaggactggtaaagccttcggagaccctgtccgtcacctgcactgtctctggtggctccatcagtagttactactggagctggatccggcagtccccagggaagggactggagtggattgggtatatcaattacagtgggaccaccaactacaacccctccctcaagagtcgagtcaccatatcagtagacacgtccaacaataagttctccctgaagctgagctctgtgaccgctgcggacacggccgtttattattgtgtgagagggggagatatagagactaccatggagttctggggccagggaaccctggtcaccgtctcctcag

SEQ ID NO: 3191 - DNA, 366 bp, Artificial Sequence
  Synthetic construct
caggtgcagctacaggagtcgggcccaggactggtgaagccttcggagaccctgtccctcacctgcaatgtctctggcggccccagcgatagttcctactggagctggatccggcagtccccggggaggggactggagtggatgggatatgtccatcacactgggagcaccaactacaacccctccctcaagagtcgagtcaccatttcagtggactcgtccaagagccagttgtccctgaggctgagctctgtgaccgctgaggacacggccatatattactgtgcgcgaaatgggcctaagtggaacaattactactactacatggacgtctggggcgaagggaccacggtcaccgtctcctca

SEQ ID NO: 3192 - DNA, 361 bp, Artificial Sequence
  Synthetic construct
caggtgcagctgcaggagtcgggcccaggactggtgaaaccttcggagaccctgtccctcacctgcactgtctctggtgcctccatcagtcgttactattggagctggattcggcagcccccagggaagggactggagtggattggaattgtctactatactgggagcaccacctacaacccctccctcaagagtcgagtcaccatctcaatagacacgtccaagaatcagttctccctgaacctggggtctgtgaccgccgcggacagggccgtgtattattgtgtgaggacccttagagatggcttcaattcctggttcgacccctggggcctgggaacccttgtcaccgtctcctcag

SEQ ID NO: 3193 - DNA, 363 bp, Artificial Sequence
  Synthetic construct
caggtgcagctacagcagtggggcggaggactcttgaagccttcggagaccctgtccctcacctgcggtgtctatggtggctccttcagtgattacgactggagctgggtccgccagaccccagggaaggggctggagtggattggagagatcaatcatactggaaagtccaactacaacccgtccctcgagggtcgcgtctccctttcaatagacatgtcaaagaaacagtcgtcactaaaactgacctctgtgaccgccgcggacacggctatttattattgtgcgagaggcccacccatagacgactactactactacatggacgtctggggcaaagggaccacggtcaccgtctcctca

SEQ ID NO: 3194 - DNA, 382 bp, Artificial Sequence
  Synthetic construct
ctggtgcagctgcaggagtcgggcccaggactggtgaagccttcggagaccctgtccctcacctgcactgtctctggtggctccatcagtacctactactggagctgggtccggcagcccccaggaaagggactggaatacattgggtatatctattacagtgggagcaccaattacaacccctccctcaagagtcgagtcaccatatcagtagacacgtccaagaaccagttctccctgaatatgagctctgtttccgccgcagacacggccgtttattattgtactagacatctgatgaattttgatttctggagtggctattatacggtgaacgcttttgatatctggggccaagggacaatggtcaccgtctcttcag

SEQ ID NO: 3195 - DNA, 364 bp, Artificial Sequence
  Synthetic construct
caggtgcagttgcaggagtcgggcccaggactggtaaagccttcggagaccctgtccctcacttgctctgtctctggtggctctattacttctaactactggagttggatccgacagcccccaggaaagggtctggagtgggttgggtacatctatgacactgggagcaccaagtacaacccctccctcaagggtcgagtcaccatatcatcagacatgtccaagaaccagttctccctcaaactgacctctctgaccgctgcggacacggccatctattactgtgcgagaaggacatatgctgttaacggtgattactactttgactcctggggccagggaaccctggtcaatgtctcctcag

SEQ ID NO: 3196 - DNA, 382 bp, Artificial Sequence
  Synthetic construct
caggtgcaactgcaacagtggggcgcaggagtgttgaagccttcggagaccctgtccctcacctgcgctgtcgatggtgggtccttcagtggttacttctggagttggatccgccagcccccaggaagggggctggagtggattggggaaatcactcatcgcggagacatcagatacaacccgtccctcaagagtcgggtcaccatatccgttgacacgtccaagaaccacttctccctgaacctgacctctgtgaccgccgcagacacggctgtatattattgtgcgcgaggccttttttattttgggtcggggacttatgcacgagatccacggagttgggggtactggggccagggagccccggtcaccgtctcctcag

SEQ ID NO: 3197 - DNA, 378 bp, Artificial Sequence
  Synthetic construct
caggtgcaaatacaacagtggggcgcaggactgttgaagccttcggagaccctgtccctcacctgcgctgtctatggtgggtccttcagttcttactcctggagttggatccgccagcccccagggaagggactggagtggattggagaaatcagtcatagtggaaccacaaactacaacccgtccctcacgagtcgactcaccatatcaattgacacgtccgagaatgaatcttccttgaggctgagctctgtgaccgccgcggacacgggtgtatatttctgtgcgagaggggaggcgatagtattgtttggggagctgttaaaacgcccttatatggatgtctggggcaaagggaccacagtcaccgtctcctca

SEQ ID NO: 3198 - DNA, 367 bp, Artificial Sequence
  Synthetic construct
caggtgcagctacagcagtggggcgcaggactgttgaagccttcggagaccctgtccctcacctgcggtgtctatggtgagtccttcattgggtactactggagttggatccgccagcccccagggaaggggctggagtggattggggaagtcaatcatagtggaagcaccaactacaacccgtccctcaagagtcgagtcagtatatcagtagacacgtccaagaaccagttttccctgaagttgaactctgtgaccgccgcggacacggctgtgtatttctgtgcgagaggctcagcacgtctagcagcaggaagaagtgcttttgatttctggggccaagggacaatggtcaccgtctcttcag

SEQ ID NO: 3199 - DNA, 370 bp, Artificial Sequence
  Synthetic construct
caggtgcagctacagcagtggggcgcaggactgttgaagtcttcggagaccctgtccctcacctgcgctgtttatggtgggtccttcagtggttactactggagttggatccgccagcccccagggaaggggctggagtggattggggaaattaatcatagtggaagcactaattacaacccgtccctcaaaagtcgagtcaccatatcaggagacacgtccaagaaccaattctccctgaagatgaactctgtgaccgccgcggacacggctgtgtattattgtgcgaggacccccccatatagtggctacgattacgaaggctactttgactactggggccagggaaccctggtcaccgtctcctcag

SEQ ID NO: 3200 - DNA, 364 bp, Artificial Sequence
  Synthetic construct
caggtgcaattacagcagtggggcggaggactgttgaagccttcggagaccccgtccctcacctgcggtgtctctggtgggtccttcagtgattactactggagttggatccgccagtccccagggaaggggctggagtggattggggaaatcaatcatagtggaaccaccaactacaacccgtccctcaagagtcgagtcaccatatcagtagacacgtccaagaaccagttctccctgaacctgacctccgtgaccgccgcggacacggctgtttattattgtgcgagaggggactggtttcagggtagtggccttccttttgactcctggggccagggaagcctggtcaccatctcctccg

SEQ ID NO: 3201 - DNA, 361 bp, Artificial Sequence
  Synthetic construct
caggtgcagctgcaggagtcgggcccaggactggtgaagccttcgcagaccgtgtccctcacctgtgctgtctctggtgactccatcagtggtaatacttattcctggagttggatccggcagccaccaggggggagactggaatggattgggaatatcttctatacggggagcaccgactccaacccgtccctccagagtcgagtttccatttcagttgacacgtccaagaatcaattctccctcactctcacctctctaaccgccgcggacacggccgtgtatttttgtgccagggctgggaggggcccaagtgtctttgactactggggccagggactcctggtcaccgtctccccag

SEQ ID NO: 3202 - DNA, 364 bp, Artificial Sequence
  Synthetic construct
caggtgcacctgcaggagtcgggcccaggactggtgaagccttcggcgaccctgtccctcacctgcaatgtctctggtggctccatcagtaatcactactggagttggatccggcaggccccagggaagggactggagtggattggatatttctataacagcgggagcgccaattacaacccctccctcaagggtcgagccaccatatcagtagactcgtccaagaaccagttgtccctgaagctgaggtctgtgaccgccgcagacacggccacatatcactgtgcgacgtatgattcggggagttattaccaatctcccttagacttctggggccagggaacccgggtcaccgtctcctcag

SEQ ID NO: 3203 - DNA, 361 bp, Artificial Sequence
  Synthetic construct
caggtgcaaatacaagagtcgggcccaggactggtgaggccttcggagaccctgtcgctcacctgcagtgtctctaatggctccgtcagcagtaacttctggagttggattcggcagcccccagggaagggactggagtggattggatatgtggatcacagtgggagttccagctaccacccctccctcaagagtcgaatcaccatgtccgtagacacgtccaagaaccaggtctccctgaagctgaggtctgttaccgccgctgacacggccgtctattactgtgcgagacattcagattggatacagttgtggttctttgacttctggggccagggaaccctggtgaccgtctccgcag

SEQ ID NO: 3204 - DNA, 402 bp, Artificial Sequence
  Synthetic construct
caggtgcagctgcagcagtggggcgcagggctgttgaagccttcggagaccctgtccctcacctgcgctgtgtatggtggtgccttcagtgactactactggagttgggtccgccagttcccagggaaggggctggagtggattggcgaaatcaatcataatggagccaccagtgacaacccgtccctccagagtcgagtcgccatttccgtggacccgtacaagcagcagttctccctgagactgacgtctctgtccgccgcggacacggctgtctactactgtgcgcgagtggcagcgtatcacaatgcttcggggagtttccgtcctagtgggcgctcctactccttcttctactacatggacgtctggggcaaggggaccgcggtcaccgtctcctca

SEQ ID NO: 3205 - DNA, 361 bp, Artificial Sequence
  Synthetic construct
catcttctactacaggagtcgggcccaggactagtaaagccttgggagaccctgtccctcagttgcactgtctctggtggctccatcagtgggtacttctggagttgggtccggcagcccccaggaaagggactgcaatggatcggaactatctacttcggcgggagaaccacctccaatccctccctcaggagtcgagtcaccatttcgattgacacctctaagaatcaattcttcttgaacatggactctctgagtgctgcagacacggccgtctattactgtgcgagaatgggggcatatggcagtggcttttatgggggatactggggccagggaaccctggtcaccgtctcctcct

SEQ ID NO: 3206 - DNA, 343 bp, Artificial Sequence
  Synthetic construct
caggtgcagctgcaggagtcgggcccaggactggtgaagccttcacagaccctgtccctcacttgcactgtctcgggtgcctccgtcaacactggtaatttctattggagttgggtccggcggcccgccggacagggactagagtggattgggcgtatctatactactggaatcgccaactacatcccctccctcgaaagccgactctccatatcaatggacacgtcgaagaaccagttttccctgaatctgacctctgtgaccgcggcagactcggccgtatacttttgtacgagaagtgatagacactggggccagggaaccctagtcaccgtctcctcag

SEQ ID NO: 3207 - DNA, 370 bp, Artificial Sequence
  Synthetic construct
caggtgcacctgcaggagtcgggcccaggactggtgaagacttcggaaaccctgtccctcacctgcgttgtttctggtccctccatcaacagttcttactcctgggcctggatccgccagccccctgggaaggggctggagtggattgggactgtctatcataatgggaacacctactacaatccgtccctcaagagtcgtatctcattatttgttgacacgtccaagaggcagatctccctgaaggtcaactctgtgaccgccgcagacacggccgtctattactgtgcaaatttattttgtgggggtggtaggtgctattccctgtttgactactggggacagggaaccctggtcgccgtctcctcag

SEQ ID NO: 3208 - DNA, 379 bp, Artificial Sequence
  Synthetic construct
cagctgcaacttcaggagtcgggcccaagactcttgaggccttcggagaccctgtccctcacctgcgctgtctctggtggctccatcagggttgacacattctactgggcctggctccgccagtccccgggcaagggactggagtggattgggagtatccattatactgggcccgccctatacaacccgtccctcgagagccgagccaccttgtccgtcgacacgtcccagaatcaggtctccctacaattgacttctatgaccgccgcagacgccgctgtctattactgtgcgagacacggaggaagtacaccccactatattcgagtgaactggttcggcccctggggccggggatcccaggtcattgtctcctcag

SEQ ID NO: 3209 - DNA, 367 bp, Artificial Sequence
  Synthetic construct
caactgcagctgcaggagtcgggcccagggctggtgaagccctcggagaccctgtccctcacctgcactgtctctggtggctccatcagcagtagtagttactactgggcttggatccggcaggccccagggaagggactggaatggcttgggagtatgtatgagagtggaaacacactcatcaaaccgtccctcaagagtcgactttccatgtccaaagacacgtccaatatccaattctccctgagtctgggctctgtgaccgccacagacacggctttttattattgtgcgagacaaacttcgcttgggggagttatcgcttttgacatctggggccacgggacaagggtcaccgtctcttcag

SEQ ID NO: 3210 - DNA, 393 bp, Artificial Sequence
  Synthetic construct
cagctgcagctgcaggagtcgggcccaggactggtgaagccctcggagaccctgtccctcacctgcactgtctctggtggctccatcagcagtagtaattactattggggctggatccgccagcccccagggaagagtctggagtggattgggagtatccattatagtgggaacacctactacaacccgtccctcgagagtcgggtcaccatatccgtagacacgtccaacaaccagttctccttgaggctgatctctgtgaccgccgcagacacggctgaatattactgtgcgacccatcctcgtgggacatttgagggagcccatgactattactactactactactacatggacgtctggggcgaagggaccacggtcaccgtctcctca

SEQ ID NO: 3211 - DNA, 364 bp, Artificial Sequence
  Synthetic construct
cacctgcagctgcaggggtcggacccaggactggtgaagccttcggagaccctgtccctcacctgcactgtctctggtggctccatcagcggtactagtgactactggggctggatccgccagcccccagggaagggactggagtggattgggagtatctattatagtgggagcacctacttcaacccgtccctcaagaggcgagtcaccatatccgtcgacacgtccaagaaccagttctccctgaagctgagctctgtgaccgccacagacacggctgtgtattactgtgcgagacacccctacggtggtaactccgggcaggactactggggccagggaaccctggtcaccgtctcctcag

SEQ ID NO: 3212 - DNA, 379 bp, Artificial Sequence
  Synthetic construct
cagctgcagctgcaggagtcgggcccaggactggtgaagccttcggagaccctgtccctcacctgcactgtctctggtggctccatcagcagtaatagttactactggggctggatccgccagcccccagggaaggggctggagtggattgcaagtatctattatagtgggagcacctacttcaacccgtccctcaagagtcgagtcgccatatccgtggacacttccaggaaccagttctccctgaagctgacctctgtgaccgccgcagacacggctgtgtattactgtgcgagatcaattcctttggaatatagtagtcaaacggggggtttgttcgacccctggggccagggaaccctggtcaccgtctcctcag

SEQ ID NO: 3213 - DNA, 388 bp, Artificial Sequence
  Synthetic construct
cagctgcagctgcaggagtcgggcccaggactggtgaagccttcggagaccctgtccctcacctgcactgtctcaggtggctccatcagtagtagtacttactactggggctggatccgccagcccccagggaaggggctggagtggattgggagtatctattatagtgggatcacctactacaacccgtccctcaagagtcgagtcaccatatccgtagacacgtccaagaaccagttctccctgaaactgagctctgtgaccgccgcagacacggctgtgtattactgtgcgagacggccgcccggcgattgtactaatggtgtatgctccacgcaaaggtggttcgacccctggggccagggaaccctggtcaccgtctcctcag

SEQ ID NO: 3214 - DNA, 372 bp, Artificial Sequence
  Synthetic construct
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagagctagcagctcgtccaaatactactactactacatggacgtctggggcaaagggaccacggtcaccgtctcctca

SEQ ID NO: 3215 - DNA, 367 bp, Artificial Sequence
  Synthetic construct
cagctgcagctgcaggagtcgggcccaggactggtgaagccttcggagaccctgttcctcacctgctctgtctctggtggctccatcagcagtagtacttactactggggctggatccgccagcccccagggaaggggctggagtggattgggagtatctattatagtgggagcagctactacaacccgtccctcaagagtcgagtcaccatatccgtagacacgtccaagaatcagttctccctgaagctgagctctgtgaccgccgcagacacggctgtgtattactgtgcgagacggggagtgggagctacgaggaaggcttttgatatctggggccaagggacaatggtcaccgtctcttcag

SEQ ID NO: 3216 - DNA, 375 bp, Artificial Sequence
  Synthetic construct
cagctgcagctgcaggagtcgggcccaggactggtgaggccttcggagaccctgtccctcacctgctctgtctctggtggctccatcagcagtagtagttactactggggctggatccgccagcccccagggaaggggctggagtggattgggagtatctattatagtgggagctcctacttcaatccgtccctccagagtcgagccaccttatccgtagacacgtcccagaaccagttctccctgaggctgagctctgtgaccgccgcagacacggctgtgtattactgtgtgagacacgactacagtagcttttactactactactacttcatggacgtctggggcacagggaccacggtcatcgtctcctca

SEQ ID NO: 3217 - DNA, 355 bp, Artificial Sequence
  Synthetic construct
cagctgcagctgcaggagtcgggcccaggactggtgaagccttcggagaccctgtccctcacctgcactgtctctggtggctccatcagcagtagtagttactactggggctggatccgccagccccccgggaaggggctggagtggattgccagtatctattatagtgggagcacctactacaacccgtccctcaagagtcgagtcaccatatccgtagacacgtccaagaaccagttctccctgaaactgagttctgtgaccgccgcagacacggctgtgtattactgtgcgagcgcattagcagctggtaaatactactggggccagggaaccctggtcaccgtctcctcag

SEQ ID NO: 3218 - DNA, 358 bp, Artificial Sequence
  Synthetic construct
caggtgcagctgcaggagtcgggcccaggactggtgaggccttcggagaccctgtccctcacctgcactgtctctggtggctccatcactagttactactggggctggatccggcagcccccaggaaagggactggagtggattgggtatgtctattacagtgggagcaccaactacaacccctccctccagagtcgaatcaccatatcagtagacacgtccaacaaccagttctccctgaagttgagctctgtgaccgctgcggacacggccgtgtatttctgtgcgagactcttaagcctgaggaatgcggcttttgatatctggggccaagggacaatggtcaccgtctctccag

SEQ ID NO: 3219 - DNA, 370 bp, Artificial Sequence
  Synthetic construct
caggtgcagctgcaggagtcgggcccaggaccggtgaagccttcggagaccctgtccctcacctgcacagtctctggtttctccatcagaaatggttatttctggggctggatccggcagcccccagggaagggactggagtggattggaagtattcaccacagtgggagcacgtcctacaacccgtccctcaagagtcgagtgaccatctccttagacatgtcgaagaaccagttctccctgaagctgacctctgtgaccgccgcagacacggccgtgtattattgtgcgagagattatattgatgtaacccacggctacagttgtttcgacccctggggccagggaaccctggtcaccgtctcctcac

SEQ ID NO: 3220 - DNA, 379 bp, Artificial Sequence
  Synthetic construct
caggtgcagctgcaggagtcgggccccggcctggtgaagccttcggagaccctgtccctcacctgcgctgtctctggttactccatcagtagtggttactactggggctggatccggcagcccccagggaagggactggagtggattgggagtgtatttcatagtgggaaaaccgactacaggtcgtccctcgagagtcgactcaccatatcattagacacgtccaacaaccgcttctccctgagactgaggtctgtgaccgccgcagacacggccatttattactgtgcgagagactttgatcaaggatattattcttcggggagttattcctggttcgacgcctggggccagggaaccctggtcaccgtctcctcag

SEQ ID NO: 3221 - DNA, 367 bp, Artificial Sequence
  Synthetic construct
caggtgcagctgcaggagtcggggccaggactggtgaagccttcggagaccctgtccctcacctgcgctgtctctggttatttcatcagtagtggtcattattggggctggatccggcagcccccagggaagggactggagtggattgggagtatgtatcatagtggcagtccctactacagtccgtccctcaagagtcgagtcaccatatccgtagacacgtccaagaacgaggtctccctgaagctgagctctgtgaccgccgcagacacggccgtatattattgtgtgagagggggccgggcaactttgaccaacgcggactttgactactggggccagggaatcctggtcatcgtctcctcag

SEQ ID NO: 3222 - DNA, 367 bp, Artificial Sequence
  Synthetic construct
caggtgcagttgcaggagtcgggcccaggactggtgaagccttcggagaccctgtccctcacctgcgctgtctctggttactccatgagcagaggttactactggggctggatccggcagcccccagggaaggggctggaatggattgggagtatctatcatagtgggagcacctactacaacccgtccctcaagagtcgagtcaccatatcagtagacatgaccaagaaccagttctccctgaagctgagctctgtgaccgccgcagacacggccgtgtattactgtgcgagaacatatagtagtggttattatagtgatgcttttgatatctggggccaagggacaatggtcaccgtctcttcag

SEQ ID NO: 3223 - DNA, 367 bp, Artificial Sequence
  Synthetic construct
cacgtgcagctgcaagagtggggcccaggactggtgaagccttcggagaccctgtccctaacctgcgttgtctctaattactccattagcagtggctcttactggggctggatccggcagcccccagggaaggggctggagtggattggaaacatctaccatagtgggaaaacctactacaattcgtccctcaagagtcgagtcgccatatcggtggacttgtccaagaaccaactctccctgaacctgcgctctgtgacggccgcagacacggccgtgtattattgtgtgagaaccccagcgttaggggagttagttggatacttccagccctggggccagggcaccctggtcatcgtctcctcag

SEQ ID NO: 3224 - DNA, 379 bp, Artificial Sequence
  Synthetic construct
caggtgcagctgcaggagtcgggcccacgactggtgaagtcttcggagaccctgtccctcacctgcgctgtctctggttactccatcagcagtggttactactggggctggatccggcagcccccagggaaggggctggagtggattggatttatctatcatagtgggaacaccgactacaacccgtccctcaagagtcgagtctccatatcagtagacacgtccaagaaccagttctccctgaagctgacctctgtgaccgccgcagacacggccgtatatttctgtgcgagagacgcatataattactatgcttcgaggagccgatacggttactttgactactggggccagggaaccctggtcactgtctcctcgg

SEQ ID NO: 3225 - DNA, 378 bp, Artificial Sequence
  Synthetic construct
caggtgcagctgcaggagtcgggcccaggactggtgaagccttcggagaccctgtccctcagttgtgttgtctctggttattccatcagtactggttactactggggctggatccggcagcccccagggaaggggctggagtggattgggactatctatcacagagggaacacctactacaacccgtccctcaagagtcgagtcaccatatccgtagacacgtccaagaaccagttgtccctgaacctgaagtctgtgaccgccgcagacacggccgtgtattactgtgcgcgagacgggacgccggctgagcgacggtcctactcctactcctacatggacgtctggggcagagggaccacggtcaccgtctcctca

SEQ ID NO: 3226 - DNA, 357 bp, Artificial Sequence
  Synthetic construct
caggtgcagcttcaggagtcgggcccaggactggtgaagccttcggagaccctgtccctcacctgcgctgtctctggttactccatcagcagtggttactactggggctggatccggcagcccccagggaaggggctggagtggattgggactatgtttcatagtgggaacacctactacagcccgtccctcaagagtcgagtcaccatatcagtagacacgtccaagaaccagttctccctgaagctgaggtctatgaccgccgcagacacggccgtgtattactgtgcgagaggggagtatctcggctactacatggacgtctggggcaaagggaccacggtcaccgtctcctca

SEQ ID NO: 3227 - DNA, 384 bp, Artificial Sequence
  Synthetic construct
caggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagaatgccgaatcttatggatacagctatggtttcctactactactactacatggacgtctggggcaaagggaccacggtcaccgtctcctca

SEQ ID NO: 3228 - DNA, 364 bp, Artificial Sequence
  Synthetic construct
caggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagaggggatgatagtagtggttatgccccctttgactactggggccagggaaccctggtcaccgtctcctcag

SEQ ID NO: 3229 - DNA, 361 bp, Artificial Sequence
  Synthetic construct
caggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagtcaatactatggttcggggaacttttgactactggggccagggaaccctggtcaccgtctcctcag

SEQ ID NO: 3230 - DNA, 382 bp, Artificial Sequence
  Synthetic construct
caggtgcagctgcaggagtcgggcccaggactggtgaagccttcggagaccctgtccctcacctgcgctgtctctggttactccatcagcactggttactactggggctggatccggcagcccccagggaaggggctggagtggattgggagtatctatcatagtgagagcacctactacaacccgtccctcaagagtcgagtcatcatatcagtagacacgtccaagaaccagttctccctgaggctgagctctgtgaccgccgcagactcggccgtgtattactgtgcgtcaacgtattactatgatagtagtgggggaagacgggttcctgttgcttttgaaatctggggccaagggacaatggtcaccgtctcttcag

SEQ ID NO: 3231 - DNA, 373 bp, Artificial Sequence
  Synthetic construct
caggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgtcgaggggttcggggagttattataaagggggttactactttgactactggggccagggaaccctggtcaccgtctcctcag

SEQ ID NO: 3232 - DNA, 379 bp, Artificial Sequence
  Synthetic construct
caggtgcagcttcaggagtcgggcccaggactggtgaagccttcggagaccctgtccctcacctgcactgtctctgtttactccatccgtagtgcttactactggggctggatccggcagcccccagggaaggggctggagtggattgggagtatgtatcccagcgggaacacctactacaacccgtccctcaagagtcgagtcaccatatcagttgacacgtccaagaaccagttcttcctgaacctgacttctgcgaccgccgcagacacggccgtgtatttctgtgcgagagcgatggattactctgatagtagtggtgattattactattacttcgatctctggggccgtggcaccctggtcacggtctcctcag

SEQ ID NO: 3233 - DNA, 370 bp, Artificial Sequence
  Synthetic construct
caggtgcagctgcaggagtcgggcccaggactggtgaagccttcggaaaccctgtccctcacctgcgctgtctctggttattccatcagcagtggttactactggggctggatccggcagcccccagggcaggggctggagtggattggcagtatctatcatagtgggagcacctactacaacccgtccctcaagagtcgagtcaccatatccgtagacacgtccaagaatcagttttccctgaaactgagctctgtgaccgccgcagacacggccgtgtattactgtgtgagagagagctcttatggttcggggactagcaaatacttcgacccctggggccagggaaccctggtcaccgtctcctcag

SEQ ID NO: 3234 - DNA, 361 bp, Artificial Sequence
  Synthetic construct
cagatacaactacaagagtcgggcccaggactggtgaagccttcggagaccctgtccctcacctgcgctgtctctggttactccatcagcagtggttactactggggctggatccggcagccccccactcaggggctagattggattgcgactatctttcatagtggaaacacctactataacccgtccctcaagagtcgagtcaccttatcaatggacacctccaagaaccagttctctttgaggttgacctctgtgaccgccgcagacacggccatgtattattgtgtgagacgctggtacggtgactaccccgcctttgactactggggccagggaaccctggtcgccgtctcctcaa

SEQ ID NO: 3235 - DNA, 370 bp, Artificial Sequence
  Synthetic construct
caggtgcaactgcaggagtcgggcccacgactggtgaagccttcggagaccctgtccctctcctgcactgtgtctggtttcttcatttccactggttaccactggggctggatccggcagtccccagggaaggggctggagtggattgggaatatcaatcatggtgggatcacccactttaacccgtccctccagagtcgagtgtccatgtcagtagacacgtccaagaacgaattctttctgaacctgaggtctgtcaccgccgccgacacggccgtttattattgtgcgagagtcttgtgtagtggtcgtaagtgccaaggggatttcgactactggggccagggaacccgggtcaacgtctcttcag

SEQ ID NO: 3236 - DNA, 375 bp, Artificial Sequence
  Synthetic construct
caggtgcagctgcaggagtcgggcccaggactggtgaggccttcggagaccctgtccctcgcctgcgctgtgtctggattctccatcaacagtgctcacctctggggctggatccggcagtcccccgggaagggactggactggattgcaagtgtttatcatagtgggaccacctactacaacccgtccctgaagagtcgagtcaccatttccctggacacgtccaagaaccagatctccctgaacctgaggtctgtgaccgccgcagacacggccatttattactgtgcgagacttatggagtcttctgaccccgctaattacttctcctacatggacgtctggggcgaagggaccacggtcaccgtctcctca

SEQ ID NO: 3237 - DNA, 376 bp, Artificial Sequence
  Synthetic construct
cagctgcagctgcaggagtcgggcccaggactggtgaagccctcggagaccctgtccctcacctgcactgtgactggtggctccatcagcagtaatagttactattggggctggatgcgccagcccccagggaaggggctggagtggattgggagtatctattatagtggggaaacttattacaacccgtccctcaagagtcgagtctccatatccgtagacacgtccacgaatcacttctccctgaagctgacctctgtgaccgccgcagacacggctgtgtatttctgtgcgaccctgagttcttattatgatattttgactggtttggcctcggacgtctggggcaaagggaccacggtcaccgtctcctcag

SEQ ID NO: 3238 - DNA, 364 bp, Artificial Sequence
  Synthetic construct
caggtgcagctgcaggagtcgggcccaggactggtgaagccttcggagaccctgtccctcacctgcgttgtctctggtttctccatgagtgatagttactactggggctgggtccggcggcccccagggaaggggctggagtggattgggaatatctatcatagtgggaccttctaccagaacccgtccctcaagaggcgagtcaccatatccatggacacgtccagccaccaattctccctggacctgcgctctgtgaccgccgcagattcggccgtttattactgtgcggggagacgctcggggaggggtgattactactttgaattgtggggccagggaatcccggtcaccgtctcgtcag

SEQ ID NO: 3239 - DNA, 364 bp, Artificial Sequence
  Synthetic construct
caggtgcagctgcaggagtcgggcccaggactggtgaagccttcggagaccctgtccctcacctgcgctgtctctggttactacatcaggactggttactactggggctggttccggcagtccccaggggggggtctggagtggattgggaacatctaccacagtgggggcacctactacaacccgtccctcaagagtcgagtcaccatttcagtggacacgtccaagaaccagttctccctgaagctgagctctgtgaccgccgcagacacggccgtttattattgtgcgagagaaggttactatgatggtagtggttattacactcactggggccagggaaccctggtcaccgtctcctcag

SEQ ID NO: 3240 - DNA, 355 bp, Artificial Sequence
  Synthetic construct
caggtgcagctgcaggaatcggggccaggactggtgaagtcttcggagaccctgtccctcagctgtactgtctctggtttctctctcatcggtggttaccactggggttggatccggcagcccccagggaagggggtggagtggatagggagtgtctttcatactgggacgacctactacaatccggccttcaagagtcgcgcctccatatctgtggacacgtccaagaacctgttctccctgaatgtgaagtctgcgaccgccgcagacacggccgtgtactattgtgcgagagtgggcattgcagcaggtgtcgacgtctggggccagggagccctggtcaccgtctcctcag

SEQ ID NO: 3241 - DNA, 388 bp, Artificial Sequence
  Synthetic construct
caggtccagctggtgcagtctggggctgaggtgaggaagcctgggtcctcggtgaaggtctcctgcaaggcttccggaggcaccttcagcaggtatgctttcaactgggtgcgacaggcccctggacaagggcttgagtgggtgggagggatcatcccgatccttggcacagcaaactacgcacagaagttccagggcagagtcacgattatcgcggacgtgtccacgagcacagcctacctggaactgagcagcctgagatctgaggacacggccgtttattactgcgcgagagagagggcggattacgatctttttactggttatccctcacgcccagatgcttttgaaatctggggccaagggacattggtcagcgtctcttcag

SEQ ID NO: 3242 - DNA, 375 bp, Artificial Sequence
  Synthetic construct
caggtcccgctggtgcagtctggggccgaactgaagaagcctgggtcctcggtgacggtctcctgcgaggcttctggaggcactttcatcaacaatgttttcagctgggtgcgacaggcccctggacaaggccttgagtggataggagggatcatccctgtctttggtacaactaattacgcacagaaattcaagggcagagtcatcattaccgcggacgaatccacaaacacagcctacatggagctgaatagtctgacatcagatgacacggccgtctactactgtgcgagacgcctggggtgggaacagggcggccgtcactcctactacatggacgtctggggcaccgggacaacggtgaccgtctcctca

SEQ ID NO: 3243 - DNA, 369 bp, Artificial Sequence
  Synthetic construct
caggtccaactggtgcagtctggggctgaggtgaagaggcctgggtcctcggtgaaggtctcctgcaagactcctgagggcaccctcaccaagtttgctttcagctgggtgcgacaggcccctggacaagggcttgagtggatgggaggcatcattcctctctttggaacaccaaactacgcacagaagttccagggcagagtcaccataagcgcggacgaacgcacgaatacaatctatatggaggtgagcagcctgacatctgaggacacggccgtctatttttgtgccagagatgggggctacgatgcagtcttattctactacctgggcgtctggggcggagggaccagtgtcaccgtctcctca

SEQ ID NO: 3244 - DNA, 358 bp, Artificial Sequence
  Synthetic construct
caggtccagctggtgcagtctggggctgaggtgaagatgcctgggtcgtcggtgaaggtctcctgcagggcttctggagcctccttcagcaatcatgctttcagttgggtgcgacaggcccccggacaaggtcttgagtggatgggagggagcatccctgtccttggcacaacaaactacgcacagaaattccagggcagagtcacgatcaccagagacgattctaagaccacaatttatatggagttgagcagtctgagatctgaggacacggccgtctattactgtgggaggatccatgatagtggttggttcgttctttattggggccagggaacccaggtcaccgtctcctcag

SEQ ID NO: 3245 - DNA, 367 bp, Artificial Sequence
  Synthetic construct
cgggttctgctggtgcagtctggatctgagctgaagaagcctggggcctcagtgaaggtctcctgcaagacctctgatggcgcctttagcacccatgctttcagttgggtgcgccaggcccctggacaagggcttgagtgggtgggatggatcagtgcttccaacggtcacacaaactacgcacagggactcgaggacagagtcaccatgaccacagacacaaccacaaagacagcctatctggagttgaggagcctgaaatctgacgacacggccgtctatttctgtgcgaggcacccgcggaagttcggggagttattgggatttgactcctggggccagggaaccctggtcgccgtctcctcag

SEQ ID NO: 3246 - DNA, 296 bp, Artificial Sequence
  Synthetic construct
gggactcatcttcagtgccgttggcttccactgggtccgccaggctccaggcaaggggctggagtgggtggcagttattagatacgatggggggaagcagtactacgcagactccgtgaagggccgattcaccatctccagagacgattccaagaacacgctgtatctgcaattgaccagcctgagacctgaagacacggctgtatattactgtgcggcggagggaggtgattgtcttaatggtgtgtgctataaagtctcctggggcccgggaaccctggtcaccgtctcctcag

SEQ ID NO: 3247 - DNA, 355 bp, Artificial Sequence
  Synthetic construct
gaggtgcagctggtggagtctgggggaggcctggtcgagcctggggggtccctgagactctcttgtataacctcaggattcaccttcagtgactacaccttccactgggtccgccaggctccagggaaggggctggagtgggtctcatccattagtagtggtcgtgttttcattcattacgcagactcagtgaggggccgattctccgtctccagagacaacgccaagaattcagtgtttctgcaaatggacagcctgagagtcgaggacacggctgtttattattgtgcgagaggtctgtcctcagtggctggcacggggtggggccagggaaccctggtcaccgtctcctcag

SEQ ID NO: 3248 - DNA, 367 bp, Artificial Sequence
  Synthetic construct
gaggtccagttggtacagtccggggctgaggtgaagaggcctggggccaccgtgaaaatctcctgcaaggcttctggatacaccttcagcgacttctacttccactgggtgcaacaggccccggaaaaagggcttgagtggatgggacgtattgatcctgacgatggtgaagttctatatgcagagaagttccagggcagagtcaccatcaccgcagacacgtctacagacacactcttcatggaactgagcaatttgaaatctgacgacacggccgtgtattactgtgcatcagcagagcagtggcccacggagcacgacgcttttgatatctggggccaagggacaatggtcaccgtctcttcag

SEQ ID NO: 3249 - DNA, 379 bp, Artificial Sequence; identical to SEQ ID NO: 1768
  Synthetic construct

SEQ ID NO: 3250 - DNA, 373 bp, Artificial Sequence
  Synthetic construct
caggcgcagctggtggagtcggggggaggcttggtcaagcctggagggtctctgagactctcgtgtatagcctctggattcacgttcggcgaccactacttgacctggatacgcctgattcaagggaggggcctggagtgggtgtcatatatcagtgggggtggcagaaatacagactatatagactctgtgaagggccgattcaccatttccagggacaaatccaggaactcgctctatctgcaaatggacagcctcaaagtcgaagactcgggtgtctattattgtgcgagaggaggcggtgggttcagtcatggccgcctcaaggctcttgatgtctggggtctggggacaaaggtcaccgtcgcttcag

SEQ ID NO: 3251 - DNA, 370 bp, Artificial Sequence
  Synthetic construct
gacgtgcagctggtggagtctgggggaggcgtggcacggcctggggggtccctgagactctcctgtgaagcttctggattcatctttgatgattttggcttgacctgggtccgccaagctccagggaaggggctggaatgggtcgctggtcttaattggaagggtggtaacatacattatgcagactctgtgaagggccgattcaccatctccagagacaacgccaagaactccctctatctggagatgaacagtctgagagtcgaagacacggccttgtattactgcgcgagagtcggcctgttgcagcaggtggcccatgatgctttggatatctggggccaagggacactggtcaccgtctcttcag

SEQ ID NO: 3252 - DNA, 367 bp, Artificial Sequence
  Synthetic construct
caggtgcagctggtggaatctgggggaggcttggtcaagcctggagggtccctcagactctcctgtgcggcctccggattcagcatcagtgactactcgttgagctggatccgccaggctccagggagggggctggagtgggtttcatacattactagtggtggtcgtaacatacaatacgcagacgctgtgaggggtcggttcaccatctccagggacaacgccgagaactcactgtatctacaaatgaacagcctgagagccgacgacacggctgtttattattgtgcgagaccttgtagtggtgctaactgcttcaacacggcgggtctctggggccagggaaccctggtcaccgtctcctcag

SEQ ID NO: 3253 - DNA, 373 bp, Artificial Sequence
  Synthetic construct
caggtgcagctggtggagtctgggggaggcgtggtccagcctgggaggtccctgaggctctcctgtgcagcctctggattcacgttaaatacctatggcttgcactgggtccgccaggctccaggcaaggggctggagtgggtggctgttagtccatatgatggaagcagtcaattctacgcagactccgtgaagggccgattcaccatctccagagacaattccaagaacacactatctctgcaaatggacagcctgagagctgacgacacggccacttatttctgtacgagaggccggctgattttcagcagcagccggtacgatgcttttgatatctggggccaagggacactggtcatcgtctcttcag

SEQ ID NO: 3254 - DNA, 367 bp, Artificial Sequence
  Synthetic construct
caggtgcaactggtgcagtctggggctgaggtgaagaagcctggggcctcagtggaggtctcctgcaaggcttctggatacaacttcctcggccactatttgcactgggtgcgacaggcccctggacaaggccttgagtggatgggatggatcaaccctgtcagtggtgacgcatactatgcacagaaatttcagggcagggtcaccatgaccagggacacgtccatcagtgctgcctacatggagttgagcaggctgaaatatgacgacgcggccatttatttctgtgcgagagatatggggcgtattggaagtagcaccgaatttgactgctggggccagggaaccctggtcaccgtctcctcag

SEQ ID NO: 3255 - DNA, 361 bp, Artificial Sequence
  Synthetic construct
caggtccagttggtacagtctggggctgaggtgaagaggcctggggcctcagtgaaggtctcctgcaaactttccggatacaccctcaccggaatatccttgcactgggtgcgacaggctcctggagaaggacttgagtggatgggaggtcctgaccctgaagatggcgcaacaatctacgcacagaagttcctgggcagagtcaccatgaccgaggacacaactgcagacacagcctacatggagctgaccagcctgacatttgcggacacggccgtgtattactgtgcaacagatcggcgagtggaaactctctactttcacttctggggccagggaaccctggtcaccgtctcctcag

SEQ ID NO: 3256 - DNA, 370 bp, Artificial Sequence
  Synthetic construct
cagatcaccttgaaggagtctggtccaacgcttgtagaggccacacagaccctcacgctgacctgcaccttctctgggttcccactgaccaccgaaaaagtgggtttggcctggatccgtcagccccccggaaaggccctagagtggcttgcattaatctacgggaatgatgataagttctacagcccgtctctaaaggacagactctccatctccaaggatactttcattaaccaggtggtccttacaatgaccaatgtggaccctctggacacagccacatattactgtgtacgcgactatgattacgttgggggcagttatcgtcttgaccggtggggccagggaaccctggtcaccgtcacctcaa

SEQ ID NO: 3257 - DNA, 367 bp, Artificial Sequence
  Synthetic construct
caggtccaattgctgcagtctggggctgaggtgaagacgcctgggtcctcagtgaaaatctcctgcacggcttctggaggcaccttcagcggctatggctttagttgggttcgacaggcccctggacaagggcttgagtggatgggtggcttcttccctctccttggaacaccaacctacgcacagaagttcggggggagagtcaccattgacgcggacgaattcacgagcacagccttcatggaactgagcgacctgcgatctgaagacactgccctgtactcctgtgcgagacttctcaaggggtccagttggtacaatggtcttgacatctggggccacgggacaatggtcatcgtctcttcag

SEQ ID NO: 3258 - DNA, 364 bp, Artificial Sequence
  Synthetic construct
caggtgcagctggtggagtctgggggaggcgtggtccagcctgggaggtccctgagactctcctgtgcagcctctggattcaccttcaggagctatggctttcactgggtccgccaggctccaggcaaggggctggagtgggtggcagttatttcatatgatggaggtcttaaatactatgcagactccgtgaagggccgattcaccatctccagagacaattccaagaacacggtgtatttgcaaatgaacagcctgggagctgacgacacggctgtatatttctgtgcgaaacggtataatactacccacctttggtactttgactcctggggccagggaaccctggtcaccgtctcctcag

SEQ ID NO: 3259 - DNA, 66 bp, Artificial Sequence
  Synthetic construct
tgtgcgagacatcgggattacgacattttgactggttattatatgggggactactttgactactgg

SEQ ID NO: 3260 - DNA, 54 bp, Artificial Sequence
  Synthetic construct
tgtgcgagacttaacttggggttcctacagattgggggttcccttgatatctgg

SEQ ID NO: 3261 - DNA, 57 bp, Artificial Sequence
  Synthetic construct
tgtgcgagagctcggggttattattatgatagtagtggttatcaaattgactactgg

SEQ ID NO: 3262 - DNA, 63 bp, Artificial Sequence
  Synthetic construct
tgtgcgagagttattactagggcgagtcctggcacagacgggaggtacggtatggacgtctgg

SEQ ID NO: 3263 - DNA, 87 bp, Artificial Sequence
  Synthetic construct
tgcgcgcggggccacagtagctcgtctcaacggtctagcttcgacggtaactttttatactactactatcaccaaatggacgtctgg

SEQ ID NO: 3264 - DNA, 69 bp, Artificial Sequence
  Synthetic construct
tgtgtgacttctttaattcggccatattgtagtggcggtgtctgctattcgaactggttcgacccctgg

SEQ ID NO: 3265 - DNA, 54 bp, Artificial Sequence
  Synthetic construct
tgtgcgagaggtcggggattgcagcaccagctgacagactggttcgacccctgg

SEQ ID NO: 3266 - DNA, 54 bp, Artificial Sequence
  Synthetic construct
tgtgcgagagtcccccccccgggagtggctaataataagtggttcgacctctgg

SEQ ID NO: 3267 - DNA, 66 bp, Artificial Sequence
  Synthetic construct
tgtgcgagaggggaaggtccggggacttatatagtctcggggcgatggggctactttgagttctgg

SEQ ID NO: 3268 - DNA, 39 bp, Artificial Sequence
  Synthetic construct
tgtggtagaccaggaatggcagaagttggtacttattgg

SEQ ID NO: 3269 - DNA, 57 bp, Artificial Sequence
  Synthetic construct
tgtgcgaaagatcgcagtagtggctggtaccggggttttggggggattgactactgg

SEQ ID NO: 3270 - DNA, 39 bp, Artificial Sequence
  Synthetic construct
tgttcgagaaggagggctgggcccgattttgattactgg

SEQ ID NO: 3271 - DNA, 45 bp, Artificial Sequence
  Synthetic construct
tgtactacccgacatcaatattgtactactaccaggtgcccctgg

SEQ ID NO: 3272 - DNA, 36 bp, Artificial Sequence
  Synthetic construct
tgtacggccgcgcgagttgcctggttcgacccctgg

SEQ ID NO: 3273 - DNA, 45 bp, Artificial Sequence
  Synthetic construct
tgcacgacaatattcggagaagtgttatatccttttgactcctgg

SEQ ID NO: 3274 - DNA, 54 bp, Artificial Sequence
  Synthetic construct
tgtgcaacagtgtataccaatgcctggtacggaggcgcgggttttgactactgg

SEQ ID NO: 3275 - DNA, 69 bp, Artificial Sequence
  Synthetic construct
tgtgcgagagcggcaattaaacgggatgggtatggttcggggagttatccagatgctttagacatctgg

SEQ ID NO: 3276 - DNA, 54 bp, Artificial Sequence
  Synthetic construct
tgtgcgaaacctccgggtaagggagcagtggctggcacctactttgactactgg

SEQ ID NO: 3277 - DNA, 45 bp, Artificial Sequence
  Synthetic construct
tgtgcgagagatagttgtagtggtggaagttgctatgactactgg

SEQ ID NO: 3278 - DNA, 45 bp, Artificial Sequence
  Synthetic construct
tgcgcgagacagggtctcggtggtcgggcctcgggagactcctgg

SEQ ID NO: 3279 - DNA, 57 bp, Artificial Sequence
  Synthetic construct
tgtgcgagatctccacctgcttatgccaactcaataaacaactggttcgacccctgg

SEQ ID NO: 3280 - DNA, 45 bp, Artificial Sequence
  Synthetic construct
tgtgcgagagataatagtactgggtggtattggtttgatccctgg

SEQ ID NO: 3281 - DNA, 48 bp, Artificial Sequence
  Synthetic construct
tgtgcgaggggggaccggagcgtttaccccaactggttcgacctctgg

SEQ ID NO: 3282 - DNA, 48 bp, Artificial Sequence
  Synthetic construct
tgtgcgagagccctctacggtggtcggggacactggttcgacccctgg

SEQ ID NO: 3283 - DNA, 36 bp, Artificial Sequence
  Synthetic construct
tgtgcgagactggactttcggggagtcctccgctgg

SEQ ID NO: 3284 - DNA, 60 bp, Artificial Sequence
  Synthetic construct
tgtgcgagagacttaacggaagtggtgggagcttctgtttccgatgcttttgatatctgg

SEQ ID NO: 3285 - DNA, 66 bp, Artificial Sequence
  Synthetic construct
tgtgcgagaggatccttggcttatgatactagtggttattactaccgcaacttcttcgacccctgg

SEQ ID NO: 3286 - DNA, 75 bp, Artificial Sequence
  Synthetic construct
tgtgcgagagttcgctacgatttttggagtggttatgagggccggggggaggaccactatcacatggacgtctgg

SEQ ID NO: 3287 - DNA, 45 bp, Artificial Sequence
  Synthetic construct
tgtgtgacagatagcgcagggagcccctatgcctttgatatttgg

SEQ ID NO: 3288 - DNA, 51 bp, Artificial Sequence
  Synthetic construct
tgtgcaacaaaaggaggattttccaattctcggggagttatgaacttctgg

SEQ ID NO: 3289 - DNA, 39 bp, Artificial Sequence
  Synthetic construct
tgtgcgagagggggccgatgggatgcttttgatatctgg

SEQ ID NO: 3290 - DNA, 54 bp, Artificial Sequence
  Synthetic construct
tgtgcgagagacctcccctatacatattgtggtgatgactgctattccctctgg

SEQ ID NO: 3291 - DNA, 57 bp, Artificial Sequence
  Synthetic construct
tgtgcgaggggcaagcagctcgtccggttccactactactactacatggacgtctgg

SEQ ID NO: 3292 - DNA, 75 bp, Artificial Sequence
  Synthetic construct
tgtgcgagaggcaaagggcttgattacgatattttgactggttgggggtggtactactactacatggacgtctgg

SEQ ID NO: 3293 - DNA, 69 bp, Artificial Sequence
  Synthetic construct
tgtgcgagaggctctagtggttcggggagttattatagctactactactactactacatggacgtctgg

SEQ ID NO: 3294 - DNA, 45 bp, Artificial Sequence
  Synthetic construct
tgtgcgagatcggattactatgatagtagtggttatggtctctgg

SEQ ID NO: 3295 - DNA, 42 bp, Artificial Sequence
  Synthetic construct
tgtgcgcgagggactatgatcgcgaaaaactttgactcctgg

SEQ ID NO: 3296 - DNA, 57 bp, Artificial Sequence
  Synthetic construct
tgtgcgagagccggtcggaggccgccctttagtaaccaccctaattttgactcttgg

SEQ ID NO: 3297 - DNA, 51 bp, Artificial Sequence
  Synthetic construct
tgcgtcgctcggagtcccccagcctacttctactactacatgaatgtctgg

SEQ ID NO: 3298 - DNA, 42 bp, Artificial Sequence
  Synthetic construct
tgtgcgaggacaaattacggtgaccaatattttgactactgg

SEQ ID NO: 3299 - DNA, 60 bp, Artificial Sequence
  Synthetic construct
tgtgcgagagcgccggggattgtggcggtcagagccacggagggctggtacgacccctgg

SEQ ID NO: 3300 - DNA, 57 bp, Artificial Sequence
  Synthetic construct
tgtgcgagagaggtcggttgtagtggtattaactgccagggctggttcgacccctgg

SEQ ID NO: 3301 - DNA, 69 bp, Artificial Sequence
  Synthetic construct
tgtgcgagagagaaaattgggcccaaaacttacgatattttgactggttacactatctttgactactgg

SEQ ID NO: 3302 - DNA, 48 bp, Artificial Sequence
  Synthetic construct
tgtgcgagaggggggtatgattacctttgggggagtcatgggtactgg

SEQ ID NO: 3303 - DNA, 54 bp, Artificial Sequence; identical to SEQ ID NO: 1772
  Synthetic construct

SEQ ID NO: 3304 - DNA, 60 bp, Artificial Sequence
  Synthetic construct
tgtgcgagagatctatggtatgattttgatagcagtgctgcggggtcccttgacgactgg

SEQ ID NO: 3305 - DNA, 36 bp, Artificial Sequence
  Synthetic construct
tgtgcgacagacctaggagcaccttcggggcactgg

SEQ ID NO: 3306 - DNA, 51 bp, Artificial Sequence
  Synthetic construct
tgtgcgatagatgtgggggctactgggggggcctactactttgactactgg

SEQ ID NO: 3307 - DNA, 69 bp, Artificial Sequence
  Synthetic construct
tgtgcgagatgtcgtgtaggtcggacaagtatgtctcagcccctaatcggggctgcttttgatatctgg

SEQ ID NO: 3308 - DNA, 36 bp, Artificial Sequence
  Synthetic construct
tgtgcgagagcaaggtacactgtggatgactactgg

SEQ ID NO: 3309 - DNA, 75 bp, Artificial Sequence
  Synthetic construct
tgtgcgagagatggaaattacgatttttggagtggttataacccttttgggtactaccactacatggacgtctgg

SEQ ID NO: 3310 - DNA, 51 bp, Artificial Sequence
  Synthetic construct
tgtgcgagagccccttcggacgcccattactattactatatggacgtctgg

SEQ ID NO: 3311 - DNA, 66 bp, Artificial Sequence
  Synthetic construct
tgtgcgagggaaaattacattttacgatatttaccggtggcccggcggggcgctgttgatatctgg

SEQ ID NO: 3312 - DNA, 57 bp, Artificial Sequence
  Synthetic construct
tgtgctatcttaacattttacgatattttgagtggcccctactcgtttgacttctgg

SEQ ID NO: 3313 - DNA, 54 bp, Artificial Sequence
  Synthetic construct
tgtgcgagagatggggcccggatagtgggactgactcatgcacttgatatttgg

SEQ ID NO: 3314 - DNA, 60 bp, Artificial Sequence
  Synthetic construct
tgtgctcggggaaagagacccggctactgcagcggaggcgtctgttcctctgaatattgg

SEQ ID NO: 3315 - DNA, 60 bp, Artificial Sequence
  Synthetic construct
tgtgctcggggaaagagacccggctactgcagcggaggcgtctgttcctctgactattgg

SEQ ID NO: 3316 - DNA, 57 bp, Artificial Sequence
  Synthetic construct
tgcgcgagacacccggctacatcaatggctggcatgtggggttacattgacacctgg

SEQ ID NO: 3317 - DNA, 57 bp, Artificial Sequence
  Synthetic construct
tgtgcgagagtggtgggcgtccgacactgggagcagttctactacatggacgtctgg

SEQ ID NO: 3318 - DNA, 30 bp, Artificial Sequence
  Synthetic construct
tgtgtgagacgcccctggttcgacccctgg

SEQ ID NO: 3319 - DNA, 75 bp, Artificial Sequence
  Synthetic construct
tgtgcgacagagggcaaaggcgcaagtaaggcatattgtggggatgagtgctccttctcattctttgaccagtgg

SEQ ID NO: 3320 - DNA, 66 bp, Artificial Sequence
  Synthetic construct
tgtgcgagcctagatgaaagacgaggatacagctatggttaccacttctattacatggacgtctgg

SEQ ID NO: 3321 - DNA, 60 bp, Artificial Sequence
  Synthetic construct
tgtgcgagagacttaggtatagcagtggctggtaagagggacgatgcttttgatatctgg

SEQ ID NO: 3322 - DNA, 63 bp, Artificial Sequence
  Synthetic construct
tgtgcgagagagcaaggtcccgaatatagtgggagctactactactactacatggacgtctgg

SEQ ID NO: 3323 - DNA, 57 bp, Artificial Sequence
  Synthetic construct
tgtgcgttcagcgattactctgatagtagcggctattacttcttttttgactactgg

SEQ ID NO: 3324 - DNA, 78 bp, Artificial Sequence
  Synthetic construct
tgtgcgagaccctcgggtagggattactctcgttatggttcgggggggcgaaacttctactactacatggacgtctgg

SEQ ID NO: 3325 - DNA, 60 bp, Artificial Sequence
  Synthetic construct
tgtgcgagagacggggagtattgtggtactgcctgctccatcaactggttcgacccctgg

SEQ ID NO: 3326 - DNA, 51 bp, Artificial Sequence
  Synthetic construct
tgtgcgagagatttccaggcgtcgatggtgagtcctagggtcgcctactgg

SEQ ID NO: 3327 - DNA, 39 bp, Artificial Sequence
  Synthetic construct
tgtgcgagagccgactacggttcctctctggacgtctgg

SEQ ID NO: 3328 - DNA, 57 bp, Artificial Sequence
  Synthetic construct
tgtgcgagagattcagtagtaccagctgctatggagggcaactggttcgacccctgg

SEQ ID NO: 3329 - DNA, 39 bp, Artificial Sequence
  Synthetic construct
tgtgcgagagctgaccttaatggtgcttttgatatctgg

SEQ ID NO: 3330 - DNA, 45 bp, Artificial Sequence
  Synthetic construct
tgtgcgagaggggaagtgggagctacggtccggtttgactactgg

SEQ ID NO: 3331 - DNA, 75 bp, Artificial Sequence
  Synthetic construct
tgtgcgagagtcgtaaagggaaaacagtattacgatattttgactggttattatgagaactggttcgacccctgg

SEQ ID NO: 3332 - DNA, 66 bp, Artificial Sequence
  Synthetic construct
tgtgcgagatctgaacatccctttgactggttattctgttgcgactactactacatggacgtctgg

SEQ ID NO: 3333 - DNA, 42 bp, Artificial Sequence
  Synthetic construct
tgtgcgagagtatcgcccgcgacaatgcgggcagtctactgg

SEQ ID NO: 3334 - DNA, 72 bp, Artificial Sequence
  Synthetic construct
tgtgcggaggactcattttgtggtgatgactgctctcgataccagactcggaggggggcttttaatgtctgg

SEQ ID NO: 3335 - DNA, 45 bp, Artificial Sequence
  Synthetic construct
tgtgcgagaggggattactttgatagtatcggtttacggtactgg

SEQ ID NO: 3336 - DNA, 42 bp, Artificial Sequence
  Synthetic construct
tgtgcgagggaatcgggaggcttttcgggttttgacttctgg

SEQ ID NO: 3337 - DNA, 33 bp, Artificial Sequence
  Synthetic construct
tgtgcgagagaagtagggtggttcgacccctgg

SEQ ID NO: 3338 - DNA, 48 bp, Artificial Sequence
  Synthetic construct
tgtgcgagagaatcctcgttcgggtgggacaatgtcttggacctttgg

SEQ ID NO: 3339 - DNA, 54 bp, Artificial Sequence
  Synthetic construct
tgtgcaaatttattttgtgggggtggtaggtgctattccctgtttgactactgg

SEQ ID NO: 3340 - DNA, 60 bp, Artificial Sequence
  Synthetic construct
tgtgcgaagagatctgggtgggagtacggggggcgttcttcgtactacatggacgtctgg

SEQ ID NO: 3341 - DNA, 48 bp, Artificial Sequence
  Synthetic construct
tgtgcgagagatcaggggatacagattcgtgatgcttttgatctctgg

SEQ ID NO: 3342 - DNA, 60 bp, Artificial Sequence
  Synthetic construct
tgtgcgagagaggcagttacggttcggggaattggcttctactaccacatggacgtctgg

SEQ ID NO: 3343 - DNA, 51 bp, Artificial Sequence
  Synthetic construct
tgtgcgagaggcctagtgggacctcctatttcttcgtacctcgatctctgg

SEQ ID NO: 3344 - DNA, 69 bp, Artificial Sequence
  Synthetic construct
tgtgcgagaacatattgtggtggtgattgctatttgaggggttggatccctgtttcttttgatatctgg

SEQ ID NO: 3345 - DNA, 48 bp, Artificial Sequence
  Synthetic construct
tgtgcgagagactccaaacgtattagtctgtctcaggaagactactgg

SEQ ID NO: 3346 - DNA, 54 bp, Artificial Sequence
  Synthetic construct
tgtgcgagagccgccgagtcggctacatctactcactggtacttcgatctctgg

SEQ ID NO: 3347 - DNA, 42 bp, Artificial Sequence
  Synthetic construct
tgtgcgcgatcaggcggacccgcggcctggctcgacccctgg

SEQ ID NO: 3348 - DNA, 33 bp, Artificial Sequence
  Synthetic construct
tgtgcgactcttggtgacgaccataattcctgg

SEQ ID NO: 3349 - DNA, 51 bp, Artificial Sequence
  Synthetic construct
tgtgcgaccgtcagggagcgcctcggagtctccgggtgcccagcctactgg

SEQ ID NO: 3350 - DNA, 69 bp, Artificial Sequence
  Synthetic construct
tgtgcaacagatataaaagtccacggtgactacagagggccctacttctactactacatgggcgtctgg

SEQ ID NO: 3351 - DNA, 54 bp, Artificial Sequence
  Synthetic construct
tgtgcgagagcgtttgtgtatggttcggggagttgggctgcttttgacatttgg

SEQ ID NO: 3352 - DNA, 51 bp, Artificial Sequence
  Synthetic construct
tgtgcgagagatcgcaaagaattcgaaagacgtcactggttcgacccctgg

SEQ ID NO: 3353 - DNA, 60 bp, Artificial Sequence
  Synthetic construct
tgtgcgagggtaggggacgataacgatttttggagtggtcattccagctttgacttctgg

SEQ ID NO: 3354 - DNA, 60 bp, Artificial Sequence
  Synthetic construct
tgtgcgagagatgaaacggatgtgatggggttcagaatggggtactactttgactcttgg

SEQ ID NO: 3355 - DNA, 51 bp, Artificial Sequence
  Synthetic construct
tgtgcaatcgcaggatcagatagtagctctggattttactttgactactgg

SEQ ID NO: 3356 - DNA, 48 bp, Artificial Sequence
  Synthetic construct
tgtgcaacccagacatatacttcggagagctcccggggtgacttctgg

SEQ ID NO: 3357 - DNA, 39 bp, Artificial Sequence
  Synthetic construct
tgtgcgggaggccgcgggggatatcacgctgactcctgg

SEQ ID NO: 3358 - DNA, 57 bp, Artificial Sequence
  Synthetic construct
tgtgcgcgaggacagactgtcggacgatactttaactggttaccccttcaacactgg

SEQ ID NO: 3359 - DNA, 54 bp, Artificial Sequence
  Synthetic construct
tgtgcgcgacacaggggacgtgggaattctgccggagtggggttcgacccctgg

SEQ ID NO: 3360 - DNA, 60 bp, Artificial Sequence
  Synthetic construct
tgtgcgagagatctttcggaagtggtgggagctgctgtttccgatgcttttaatgtctgg

SEQ ID NO: 3361 - DNA, 45 bp, Artificial Sequence
  Synthetic construct
tgtgcgagagcagatggctaccgaaagaaaatccttgactactgg

SEQ ID NO: 3362 - DNA, 51 bp, Artificial Sequence
  Synthetic construct
tgtgcgagacaatcaggaagtagtggttatatctcctattttaaatactgg

SEQ ID NO: 3363 - DNA, 51 bp, Artificial Sequence
  Synthetic construct
tgtgcgagaggtataagtggaattacctacccgtatcactttgactactgg

SEQ ID NO: 3364 - DNA, 69 bp, Artificial Sequence
  Synthetic construct
tgtgcgacattacgtatgatggattattatgatagtagtggtcattatccggactactttgactactgg

SEQ ID NO: 3365 - DNA, 54 bp, Artificial Sequence
  Synthetic construct
tgtgcgagacgcaacccttatggctccggccggggttataactttgactcctgg

SEQ ID NO: 3366 - DNA, 42 bp, Artificial Sequence
  Synthetic construct
tgtgcgagaactacccagtatttcttctacatggacgtctgg

SEQ ID NO: 3367 - DNA, 81 bp, Artificial Sequence
  Synthetic construct
tgtgcgcgacccgatagtggtgacgaactcatcaatccgggccggccaagtggttattacacgggggctattgatctgtgg

SEQ ID NO: 3368 - DNA, 48 bp, Artificial Sequence
  Synthetic construct
tgtgcgagatcagtgaccagtggctggtatggtactctcgactattgg

SEQ ID NO: 3369 - DNA, 51 bp, Artificial Sequence
  Synthetic construct
tgtgggagaccgcgtaatagtgggagttattatgatgcttttgatatatgg

SEQ ID NO: 3370 - DNA, 51 bp, Artificial Sequence
  Synthetic construct
tgtgcgagacattccttgtctaactttaaacaggcctggttcgacccctgg

SEQ ID NO: 3371 - DNA, 57 bp, Artificial Sequence
  Synthetic construct
tgtgcgagaaatccgggagatgatagtactggtcacccctcttactttaactactgg

SEQ ID NO: 3372 - DNA, 51 bp, Artificial Sequence
  Synthetic construct
tgtgcgagacaagagaggcgtatcggcagtggcaaccccttagagttctgg

SEQ ID NO: 3373 - DNA, 51 bp, Artificial Sequence
  Synthetic construct
tgtgtgagtcccggcgattgtagtggtggtacttgctacccggcctactgg

SEQ ID NO: 3374 - DNA, 42 bp, Artificial Sequence
  Synthetic construct
tgtgcgagacgatttccgaatagtgaacattttgtctactgg

SEQ ID NO: 3375 - DNA, 57 bp, Artificial Sequence
  Synthetic construct
tgtgcgagacatgtggcaactcgtccctactacttctactactacatggacgtctgg

SEQ ID NO: 3376 - DNA, 57 bp, Artificial Sequence
  Synthetic construct
tgtgcgcgacgtaatggttaccatgatagtagtgcttatggcggttttgatatctgg

SEQ ID NO: 3377 - DNA, 54 bp, Artificial Sequence
  Synthetic construct
tgtgcgagaggggaagatgcctacaatactgagcctgatgcttttgatatctgg

SEQ ID NO: 3378 - DNA, 42 bp, Artificial Sequence
  Synthetic construct
tgtgcgaaacatgaagcgcgtgattattactttgactcctgg

SEQ ID NO: 3379 - DNA, 33 bp, Artificial Sequence
  Synthetic construct
tgtgcgagacggaggagcttcgtggacgtctgg

SEQ ID NO: 3380 - DNA, 72 bp, Artificial Sequence
  Synthetic construct
tgtgcgagaagtagagttgtagtagtaccagctgctatgaccccctactactactactacatggacgtctgg

SEQ ID NO: 3381 - DNA, 60 bp, Artificial Sequence
  Synthetic construct
tgtgcgagacataagggaaggggacgtatagcagtggctggtaaagcttttgatatctgg

SEQ ID NO: 3382 - DNA, 42 bp, Artificial Sequence
  Synthetic construct
tgtgcgagacatcggccccactatggcctcatggacgtctgg

SEQ ID NO: 3383 - DNA, 42 bp, Artificial Sequence
  Synthetic construct
tgtgcgagacgtcaggctggagagggcccctttgactactgg

SEQ ID NO: 3384 - DNA, 54 bp, Artificial Sequence
  Synthetic construct
tgtgcgagactggattgtagtggtggtagctgctacccgcccatggacgtctgg

SEQ ID NO: 3385 - DNA, 60 bp, Artificial Sequence
  Synthetic construct
tgtgcgagatccgttcggggagtgggagattactactactactactacatggacgtctgg

SEQ ID NO: 3386 - DNA, 54 bp, Artificial Sequence
  Synthetic construct
tgtgcgagcgtcggctactatggttcggggagttctgatgcttttgatatctgg

SEQ ID NO: 3387 - DNA, 75 bp, Artificial Sequence
  Synthetic construct
tgtgcgagacgagggaaggatgataacagtgcttactacttggggaggacccgaggccgggtatttgactattgg

SEQ ID NO: 3388 - DNA, 39 bp, Artificial Sequence
  Synthetic construct
tgtgcgagacagggcggcagctaccgcattgactactgg

SEQ ID NO: 3389 - DNA, 57 bp, Artificial Sequence
  Synthetic construct
tgtgcgagagtgggggactacggtgactacggtagctactggtacttcgatctctgg

SEQ ID NO: 3390 - DNA, 45 bp, Artificial Sequence
  Synthetic construct
tgtgcccagagtgtaactggagctacagatgcttttgatatttgg

SEQ ID NO: 3391 - DNA, 48 bp, Artificial Sequence
  Synthetic construct
tgtgcgagattggggggtcctacggtgactccccgttttgactactgg

SEQ ID NO: 3392 - DNA, 51 bp, Artificial Sequence
  Synthetic construct
tgtgcgagactggcgatgaaggaatggagtgtcggtgcttttgatctttgg

SEQ ID NO: 3393 - DNA, 45 bp, Artificial Sequence
  Synthetic construct
tgtgcgagagacatgtggggccaccactacgcgttcgacccctgg

SEQ ID NO: 3394 - DNA, 54 bp, Artificial Sequence
  Synthetic construct
tgtgcccgccggtcgcagcagctcctggtccccggatgggcttttgatatctgg

SEQ ID NO: 3395 - DNA, 48 bp, Artificial Sequence
  Synthetic construct
tgtgcgagacttggggattacagtgtctccgatatggggaactactgg

SEQ ID NO: 3396 - DNA, 48 bp, Artificial Sequence
  Synthetic construct
tgtacgtttcggggggcctcttgggggagtcttcgttatagctattgg

SEQ ID NO: 3397 - DNA, 66 bp, Artificial Sequence
  Synthetic construct
tgtgcgaaagatgtggggtattgtagtagtggcagctgcttccgccccctggcttttcaaatctgg

SEQ ID NO: 3398 - DNA, 51 bp, Artificial Sequence
  Synthetic construct
tgtgccacagatcaatgggggtacggtgacttcgggaactttgactactgg

SEQ ID NO: 3399 - DNA, 51 bp, Artificial Sequence
  Synthetic construct
tgtacgcgggttttgtggttcgagggacgatatgatacttttgatgtttgg

SEQ ID NO: 3400 - DNA, 66 bp, Artificial Sequence
  Synthetic construct
tgtgcgtcccgctattgtcgtgctggcagctgctatcaccattactattactatatggacatctgg

SEQ ID NO: 3401 - DNA, 51 bp, Artificial Sequence
  Synthetic construct
tgtgcgaaagggggcggttgtagtggtgattgctattttcccctcgactgg

SEQ ID NO: 3402 - DNA, 54 bp, Artificial Sequence
  Synthetic construct
tgtgcgagaggcctggggtattacgatattttgactggtgcttttgactactgg

SEQ ID NO: 3403 - DNA, 60 bp, Artificial Sequence
  Synthetic construct
tgtgcgaaagatagatcagcctccatatatggtgcggggactcccgcccttgactactgg

SEQ ID NO: 3404 - DNA, 42 bp, Artificial Sequence
  Synthetic construct
tgtgcgaaagatcgtgacttctactacttcatagacgtctgg

SEQ ID NO: 3405 - DNA, 51 bp, Artificial Sequence
  Synthetic construct
tgtgcgaaggcgcgcgtaccagctgctatcagattctactttgactcctgg

SEQ ID NO: 3406 - DNA, 39 bp, Artificial Sequence
  Synthetic construct
tgtgcgagagtcactaggttgaactggttcgacccctgg

SEQ ID NO: 3407 - DNA, 48 bp, Artificial Sequence
  Synthetic construct
tgtgcgcgaaatgaaggatacagctattctaactacatggacgtctgg

SEQ ID NO: 3408 - DNA, 66 bp, Artificial Sequence
  Synthetic construct
tgtgcgagatccccccccccctattactacgccagtagtggttattacttcgcctttgactactgg

SEQ ID NO: 3409 - DNA, 57 bp, Artificial Sequence
  Synthetic construct
tgtgcgagagagaagaacttgtatagtggctacgatccgacgggcttaggctactgg

SEQ ID NO: 3410 - DNA, 45 bp, Artificial Sequence
  Synthetic construct
tgtgcgacctctggttcgggggcttattataaccctgactactgg

SEQ ID NO: 3411 - DNA, 63 bp, Artificial Sequence
  Synthetic construct
tgtgcgacagattccacattttacgatgttttgactactatctgggggtactttgactactgg

SEQ ID NO: 3412 - DNA, 39 bp, Artificial Sequence
  Synthetic construct
tgtgcgacagatagtgcctacgagtactttgactcttgg

SEQ ID NO: 3413 - DNA, 48 bp, Artificial Sequence
  Synthetic construct
tgcgcgagaagggaggcggcgatgagtaatggtaaccttgactactgg

SEQ ID NO: 3414 - DNA, 60 bp, Artificial Sequence
  Synthetic construct
tgtgcgagagaaccatattgtggtggtgattgcccgccgggatattggttcgacccctgg

SEQ ID NO: 3415 - DNA, 60 bp, Artificial Sequence
  Synthetic construct
tgtgcgagagaaggggttaggagcggatacagctatgcctttgatgcttttgatatctgg

SEQ ID NO: 3416 - DNA, 45 bp, Artificial Sequence
  Synthetic construct
tgtgcgagagaatactatggttcggggagttattatacttggtgg

SEQ ID NO: 3417 - DNA, 54 bp, Artificial Sequence
  Synthetic construct
tgtgcgagagatccgaggaggaatcactatgatagtagtggctctgactactgg

SEQ ID NO: 3418 - DNA, 42 bp, Artificial Sequence
  Synthetic construct
tgtgcgagagattttttgggagctagctactttgactactgg

SEQ ID NO: 3419 - DNA, 63 bp, Artificial Sequence
  Synthetic construct
tgtgcgagatccgcccagctctatgatagtagtggttattcggggggcctctttgactactgg

SEQ ID NO: 3420 - DNA, 54 bp, Artificial Sequence
  Synthetic construct
tgtgcgcctttttcgctctacggggggaactactactactacatggacgtctgg

SEQ ID NO: 3421 - DNA, 42 bp, Artificial Sequence
  Synthetic construct
tgtgcgacttcggatcggggaacgactacggtgactccttgg

SEQ ID NO: 3422 - DNA, 84 bp, Artificial Sequence
  Synthetic construct
tgtgcgagattttcggccggaaggcctcaatattgtagtggtggtacctgctaccctccggacttctattacatggacgtctgg

SEQ ID NO: 3423 - DNA, 57 bp, Artificial Sequence
  Synthetic construct
tgtgcgagagatcgaggtagcagcagctggtacgggggcgatgcttttgatttctgg

SEQ ID NO: 3424 - DNA, 30 bp, Artificial Sequence
  Synthetic construct
tgtgcgagagggggactacggcgaaactgg

SEQ ID NO: 3425 - DNA, 39 bp, Artificial Sequence
  Synthetic construct
tgtgcgagagatgaccgctacggtgaccttgatttttgg

SEQ ID NO: 3426 - DNA, 75 bp, Artificial Sequence
  Synthetic construct
tgtgcgagagggcccaattactatgatagtagaaatcattactcgccaccactcgaccagtacatggacgtctgg

SEQ ID NO: 3427 - DNA, 36 bp, Artificial Sequence
  Synthetic construct
tgtgcgagcgggaacggtgacttcgtgtacttctgg

SEQ ID NO: 3428 - DNA, 63 bp, Artificial Sequence
  Synthetic construct
tgtgcgagagaggacagagctgtggctggtccctggtcctcctactacttcatggacgtctgg

SEQ ID NO: 3429 - DNA, 27 bp, Artificial Sequence
  Synthetic construct
tgtgcgagagacgagaacgactactgg

SEQ ID NO: 3430 - DNA, 42 bp, Artificial Sequence
  Synthetic construct
tgtgcgagagatacaggatatacccggaaacttgactactgg

SEQ ID NO: 3431 - DNA, 69 bp, Artificial Sequence
  Synthetic construct
tgtgcgagagatcactacggtggtaaatccggaagcggatactactactactactacatggacgtctgg

SEQ ID NO: 3432 - DNA, 27 bp, Artificial Sequence
  Synthetic construct
tgtgcgagagctttcctggacgtctgg

SEQ ID NO: 3433 - DNA, 63 bp, Artificial Sequence
  Synthetic construct
tgtgcgagagggggcgactacgggggaacctgggcgtactactactactacatggacgtctgg

SEQ ID NO: 3434 - DNA, 66 bp, Artificial Sequence
  Synthetic construct
tgtgcgagaggtccttattactatgatagtagtagttattacccaaaagaatacttccagcactgg

SEQ ID NO: 3435 - DNA, 66 bp, Artificial Sequence
  Synthetic construct
tgtgcgagagttggtgatgatagtagtggttggggttactactactactactacatggacgtctgg

SEQ ID NO: 3436 - DNA, 48 bp, Artificial Sequence
  Synthetic construct
tgtgcgagggagaattactatggttcggggagttatttgggctactgg

SEQ ID NO: 3437 - DNA, 33 bp, Artificial Sequence
  Synthetic construct
tgtgcgaggggttatggttcgggggactactgg

SEQ ID NO: 3438 - DNA, 60 bp, Artificial Sequence
  Synthetic construct
tgtgcgagagttgggagtctttttgaactaaatggccgggagtcgggtctcgacccctgg

SEQ ID NO: 3439 - DNA, 54 bp, Artificial Sequence
  Synthetic construct
tgtacgagagttttcggattttcggcttggaacttcggtgacttttactactgg

SEQ ID NO: 3440 - DNA, 66 bp, Artificial Sequence
  Synthetic construct
tgtgcgagagatcccctttattactatgatagtggtggttattaccatgatgcttttgatatctgg

SEQ ID NO: 3441 - DNA, 45 bp, Artificial Sequence
  Synthetic construct
tgtgcgagtcgccccgaatatacgtttggttactttgactcctgg

SEQ ID NO: 3442 - DNA, 42 bp, Artificial Sequence
  Synthetic construct
tgtgcgagagacatagactggaactacggacttgactcctgg

SEQ ID NO: 3443 - DNA, 57 bp, Artificial Sequence
  Synthetic construct
tgtgcgaaagtgggcaaccgggtcccgacgaggaggggtggggcttttgatatttgg

SEQ ID NO: 3444 - DNA, 66 bp, Artificial Sequence
  Synthetic construct
tgtgcgagagatcgggcacactgtactaatagcagctgcttttcggggggctggttcgactcctgg

SEQ ID NO: 3445 - DNA, 66 bp, Artificial Sequence
  Synthetic construct
tgtgcgagaggttgggtggggcaggaccccactgcttaccgcacagggggctactttgactcctgg

SEQ ID NO: 3446 - DNA, 66 bp, Artificial Sequence
  Synthetic construct
tgtgcgagagatttggacggttactatggttcgggaagttattatcccgatgcttttgatatctgg

SEQ ID NO: 3447 - DNA, 51 bp, Artificial Sequence
  Synthetic construct
tgtgcgagagtggtcggcagcagctcctactactaccacattgacgtctgg

SEQ ID NO: 3448 - DNA, 45 bp, Artificial Sequence
  Synthetic construct
tgtgcgagagggggagaatcttactactggtacatggacgtctgg

SEQ ID NO: 3449 - DNA, 54 bp, Artificial Sequence
  Synthetic construct
tgtgcaagagaagcccgctatggttcggggagcccttggtacatggacgtctgg

SEQ ID NO: 3450 - DNA, 51 bp, Artificial Sequence
  Synthetic construct
tgtgcgagagccatagagatgtctactacggatggtgctttagatctctgg

SEQ ID NO: 3451 - DNA, 45 bp, Artificial Sequence
  Synthetic construct
tgtgtgcgtgctgacgactcttatcactactacatgttggactgg

SEQ ID NO: 3452 - DNA, 69 bp, Artificial Sequence
  Synthetic construct
tgtgtgagagataattactttgatagtagtggttattacctttacggaccccactactttgactactgg

SEQ ID NO: 3453 - DNA, 66 bp, Artificial Sequence
  Synthetic construct
tgtgcgaggttccacagggaaacatactgtggtggtgattgctattcggggacttttgatgtctgg

SEQ ID NO: 3454 - DNA, 72 bp, Artificial Sequence
  Synthetic construct
tgtgtgaggggggccccacattcgcagtataccagtttttggttctatagttactacttcatggacgtctgg

SEQ ID NO: 3455 - DNA, 39 bp, Artificial Sequence
  Synthetic construct
tgtaccacagtacataccattaggggctttgactactgg

SEQ ID NO: 3456 - DNA, 48 bp, Artificial Sequence
  Synthetic construct
tgtgtgcgagcttggcagcaactggtatggggaggtcttgatatctgg

SEQ ID NO: 3457 - DNA, 63 bp, Artificial Sequence
  Synthetic construct
tgtgcgagagatctccgagatgagagtgttgacgagtactactattactacatggacgtctgg

SEQ ID NO: 3458 - DNA, 60 bp, Artificial Sequence
  Synthetic construct
tgtgcgagagaagggatggctacaaggggttactactactactactacatggacgtctgg

SEQ ID NO: 3459 - DNA, 39 bp, Artificial Sequence
  Synthetic construct
tgtgcgagagacctcgtagtaggtgcttttgatatctgg

SEQ ID NO: 3460 - DNA, 78 bp, Artificial Sequence
  Synthetic construct
tgtgcgagaggccatgatagtagtggttattacttttttttgggggtgggctactactactactacatggacgtctgg

SEQ ID NO: 3461 - DNA, 63 bp, Artificial Sequence
  Synthetic construct
tgtgcgagaggtcttatagcagatagtagtggttattacaagttacggctatttgactactgg

SEQ ID NO: 3462 - DNA, 45 bp, Artificial Sequence
  Synthetic construct
tgtgcgagatcaccaacgggttatccctactactttgactactgg

SEQ ID NO: 3463 - DNA, 45 bp, Artificial Sequence
  Synthetic construct
tgtgcgagagatcctgactatgatactagtggtccagactactgg

SEQ ID NO: 3464 - DNA, 45 bp, Artificial Sequence
  Synthetic construct
tgtgcgagagatgatggaggggggtactggggcttagacctctgg

SEQ ID NO: 3465 - DNA, 81 bp, Artificial Sequence
  Synthetic construct
tgtgcgtccctaggacattgtcgtagtggcagctgtttagtccgaccagctgaggtctcgcagacctggttcgacccctgg

SEQ ID NO: 3466 - DNA, 54 bp, Artificial Sequence
  Synthetic construct
tgtgcgaaagatcgcagcctctccggatatagcagcagttgccacctcgactgg

SEQ ID NO: 3467 - DNA, 54 bp, Artificial Sequence
  Synthetic construct
tgtgcgagaggcctttatgagggatttgaatcaagtggtttttacagattctgg

SEQ ID NO: 3468 - DNA, 45 bp, Artificial Sequence
  Synthetic construct
tgtgttaaagctgagggcccgtatggtggctactttgaccaatgg

SEQ ID NO: 3469 - DNA, 45 bp, Artificial Sequence
  Synthetic construct
tgtgcgaaagtgaagtttggctatggctcccattttgatatctgg

SEQ ID NO: 3470 - DNA, 51 bp, Artificial Sequence
  Synthetic construct
tgtgctagagtagaatcgtactactatgacagtagtgctgttgactactgg

SEQ ID NO: 3471 - DNA, 57 bp, Artificial Sequence
  Synthetic construct
tgcgcgaaatacaaccctcggggctacggtgactacgcggggtacctcgacccctgg

SEQ ID NO: 3472 - DNA, 51 bp, Artificial Sequence
  Synthetic construct
tgtgcgaaaatcaggccaatgactacggtgacgagctcctttgactactgg

SEQ ID NO: 3473 - DNA, 60 bp, Artificial Sequence
  Synthetic construct
tgtgcgagagataccgctacattacgaagtcacgggggggccggctggttcgccccctgg

SEQ ID NO: 3474 - DNA, 54 bp, Artificial Sequence
  Synthetic construct
tgtgcgaaaccggggggctatggttcggggagtgatggtgcttttgatatctgg

SEQ ID NO: 3475 - DNA, 51 bp, Artificial Sequence
  Synthetic construct
tgtacgaatattcgagacgcatacagtgtcggttatggacttgattcctgg

SEQ ID NO: 3476 - DNA, 48 bp, Artificial Sequence
  Synthetic construct
tgtgcgaaaaggcaggcttatagcagctcgtcccccttgggccactgg

SEQ ID NO: 3477 - DNA, 57 bp, Artificial Sequence
  Synthetic construct
tgtgcgaaagatgtcagcaactacgggatttactattactactacatggacgtctgg

SEQ ID NO: 3478 - DNA, 48 bp, Artificial Sequence
  Synthetic construct
tgtgcgagttcggatgactacagtaactacggtccatttgactactgg

SEQ ID NO: 3479 - DNA, 54 bp, Artificial Sequence
  Synthetic construct
tgtgctagaggtccccccagtggatacacctttggttcctactttgactcctgg

SEQ ID NO: 3480 - DNA, 54 bp, Artificial Sequence
  Synthetic construct
tgtgcgagaggagtcactagtggttaccactcttaccccctccttgacttctgg

SEQ ID NO: 3481 - DNA, 66 bp, Artificial Sequence
  Synthetic construct
tgtgcccgagctcggggaacatataactgggactctggggcctactcttacttcatggacgtctgg

SEQ ID NO: 3482 - DNA, 51 bp, Artificial Sequence
  Synthetic construct
tgtgcgaaaattaggccaatgactacggtgacgagcgcgtttgacctctgg

SEQ ID NO: 3483 - DNA, 39 bp, Artificial Sequence
  Synthetic construct
tgtggaagagatccgggatacagtagcttggacgtctgg

SEQ ID NO: 3484 - DNA, 66 bp, Artificial Sequence
  Synthetic construct
tgtgctcgaggtcggggaacctatgactggaactccggggcctactactacttcatggacgtgtgg

SEQ ID NO: 3485 - DNA, 84 bp, Artificial Sequence
  Synthetic construct
tgcacgagaggaggcggccatttgctccgggcaggctatgagtggtccccgggagatcaaacattccacttcatgaacgtctgg

SEQ ID NO: 3486 - DNA, 36 bp, Artificial Sequence
  Synthetic construct
tgtgcgacttatcccacgggcattttgaactcctgg

SEQ ID NO: 3487 - DNA, 45 bp, Artificial Sequence
  Synthetic construct
tgtgcggcctcttacaatatccagggtttggtccttgactactgg

SEQ ID NO: 3488 - DNA, 51 bp, Artificial Sequence
  Synthetic construct
tgtgcgaaacacaaaggggagtcctatatttcttgggctcttgatttgtgg

SEQ ID NO: 3489 - DNA, 60 bp, Artificial Sequence
  Synthetic construct
tgtgcgaaaaccccctcaagaagtgtaagcagtagctggccctattactttgactattgg

SEQ ID NO: 3490 - DNA, 72 bp, Artificial Sequence
  Synthetic construct
tgtgcgaggaacgtatattgtagtggtggtagctgctactccgactactactactactacatggacgtctgg

SEQ ID NO: 3491 - DNA, 54 bp, Artificial Sequence
  Synthetic construct
tgtgcgagaccagaaagtgggagctactactcgccctggttcttcgaatgctgg

SEQ ID NO: 3492 - DNA, 48 bp, Artificial Sequence
  Synthetic construct
tgtgcgagagacaagtatagtgggaccacggatgcttttgatatctgg

SEQ ID NO: 3493 - DNA, 51 bp, Artificial Sequence
  Synthetic construct
tgtgcgagagacccacgagcgtataccgatccccgctggttcgacccctgg

SEQ ID NO: 3494 - DNA, 45 bp, Artificial Sequence
  Synthetic construct
tgtgcgagagcgggggggttcatggttcggggactcgactactgg

SEQ ID NO: 3495 - DNA, 63 bp, Artificial Sequence
  Synthetic construct
tgtgcgagagaaataagaggcgtgggctatagtagtggttattacggctggttcgacccctgg

SEQ ID NO: 3496 - DNA, 45 bp, Artificial Sequence
  Synthetic construct
tgtgcgagagtccgtacgtccctctactactacatggacgtctgg

SEQ ID NO: 3497 - DNA, 51 bp, Artificial Sequence
  Synthetic construct
tgtgcgagagatggtgtactactacgaagcttaaagcggttcgacccctgg

SEQ ID NO: 3498 - DNA, 45 bp, Artificial Sequence
  Synthetic construct
tgtgcgagagggtgggcaacagatggctactacatggacctctgg

SEQ ID NO: 3499 - DNA, 72 bp, Artificial Sequence
  Synthetic construct
tgtgcgaaagggggtccagatgcggctgtctggacgaattctcaactctcttttcatccctttgtctcgtgg

SEQ ID NO: 3500 - DNA, 48 bp, Artificial Sequence
  Synthetic construct
tgcgcgaaagtaagactgatacggcccgaggggttctttgactattgg

SEQ ID NO: 3501 - DNA, 60 bp, Artificial Sequence
  Synthetic construct
tgtgcgaaagacctctcttgtggtggtggtagctgtttttcccgggtttctgactactgg

SEQ ID NO: 3502 - DNA, 90 bp, Artificial Sequence
  Synthetic construct
tgtgcgagaggcaaaacttcttactatgatagagacaaaccgttttactatgatagtagtggtaagggtccccactgctttgactactgg

SEQ ID NO: 3503 - DNA, 54 bp, Artificial Sequence
  Synthetic construct
tgtaccacagattggggttcgacgactcattatattcaggcttttgatatctgg

SEQ ID NO: 3504 - DNA, 51 bp, Artificial Sequence
  Synthetic construct
tgtactagagattgggactactatgatagtagtggttactccagtcactgg

SEQ ID NO: 3505 - DNA, 63 bp, Artificial Sequence
  Synthetic construct
tgtactagaccggcggctgatagcagcagctggtacagccgccttacctactttgactactgg

SEQ ID NO: 3506 - DNA, 42 bp, Artificial Sequence
  Synthetic construct
tgtactagagagctctccatagagggagcttttgatatctgg

SEQ ID NO: 3507 - DNA, 57 bp, Artificial Sequence
  Synthetic construct
tgtactagagatcttctcggggtcttctcggaggggattggttggttcgacccctgg

SEQ ID NO: 3508 - DNA, 60 bp, Artificial Sequence
  Synthetic construct
tgtactagagccccggggaggggatttaggtatggttcggggagccactttgactactgg

SEQ ID NO: 3509 - DNA, 48 bp, Artificial Sequence
  Synthetic construct
tgtgcgagaggggtggctacgacctaccaatatcactttgacttctgg

SEQ ID NO: 3510 - DNA, 63 bp, Artificial Sequence
  Synthetic construct
tgtgcgagagatcgcatcagttttacgactggtgtggtcccggactggaacttcgatctctgg

SEQ ID NO: 3511 - DNA, 60 bp, Artificial Sequence
  Synthetic construct
tgtgcgaaacatttaacgaccagtattgttgtggtggtagctgcacgatttgtctcctgg

SEQ ID NO: 3512 - DNA, 48 bp, Artificial Sequence
  Synthetic construct
tgtgcgaagttggactacagtaacttacgacagagatttgactactgg

SEQ ID NO: 3513 - DNA, 42 bp, Artificial Sequence
  Synthetic construct
tgtgcgaaagatccctcctctatagtgggagccttcgactgg

SEQ ID NO: 3514 - DNA, 33 bp, Artificial Sequence
  Synthetic construct
tgtgcgaagcctatagcaggtcgtccttccgtg

SEQ ID NO: 3515 - DNA, 51 bp, Artificial Sequence
  Synthetic construct
tgtgcgaaaccgaaggaggaagagccctcatactactacatggacgtctgg

SEQ ID NO: 3516 - DNA, 39 bp, Artificial Sequence
  Synthetic construct
tgtgcgaaagataaacgggctgcccccttagactactgg

SEQ ID NO: 3517 - DNA, 57 bp, Artificial Sequence
  Synthetic construct
tgtgcgaaagattactatggttcggggacttattatatgggagcttttgatatctgg

SEQ ID NO: 3518 - DNA, 48 bp, Artificial Sequence
  Synthetic construct
tgtgccagggaggacagcagtggctggtatgatgcttttgatatctgg

SEQ ID NO: 3519 - DNA, 51 bp, Artificial Sequence
  Synthetic construct
tgtgcgaaacgggggcctgatagtagtgggtcgggcgcttttgatatctgg

SEQ ID NO: 3520 - DNA, 48 bp, Artificial Sequence
  Synthetic construct
tgtgcgaaagagggtagtggttattactcaaactggttcgacccctgg

SEQ ID NO: 3521 - DNA, 57 bp, Artificial Sequence
  Synthetic construct
tgtgcgaaagatcgagggaagatttactatgatagtagtggccaacaggactactgg

SEQ ID NO: 3522 - DNA, 60 bp, Artificial Sequence
  Synthetic construct
tgtgcgaaagatcgggcattacgatattttgactggttatttgatgcttttgatatctgg

SEQ ID NO: 3523 - DNA, 45 bp, Artificial Sequence
  Synthetic construct
tgtgcgaaagccccaggatatagcaatactgcttttgatttctgg

SEQ ID NO: 3524 - DNA, 51 bp, Artificial Sequence
  Synthetic construct
tgtgcgaaagtcggggacgtattacgatattttgactggtatgactactgg

SEQ ID NO: 3525 - DNA, 48 bp, Artificial Sequence
  Synthetic construct
tgtgcgaaatgggggctatggttcggggagttggactttgactactgg

SEQ ID NO: 3526 - DNA, 51 bp, Artificial Sequence
  Synthetic construct
tgtgcgaatcccgattacgatattttgactgtgaactggttcgacccctgg

SEQ ID NO: 3527 - DNA, 36 bp, Artificial Sequence
  Synthetic construct
tgtgcgaatcttataggagggtactttggctactgg

SEQ ID NO: 3528 - DNA, 69 bp, Artificial Sequence
  Synthetic construct
tgtgcgaagacagcatattgtggtggggattgctcttctagagtcactgcatacttctttgactcctgg

SEQ ID NO: 3529 - DNA, 48 bp, Artificial Sequence
  Synthetic construct
tgtgcgaaatcccgggcagtggctgggtacgattactttgactactgg

SEQ ID NO: 3530 - DNA, 48 bp, Artificial Sequence
  Synthetic construct
tgtgcgagaaggcagggctacagtagttcgtccccgttgaaatactgg

SEQ ID NO: 3531 - DNA, 60 bp, Artificial Sequence
  Synthetic construct
tgtgcgagagacttttggggttactatggttcggggattagaaaagagtttgatatctgg

SEQ ID NO: 3532 - DNA, 60 bp, Artificial Sequence
  Synthetic construct
tgtgcgagtcgaggaattaacggggggttcggggaagatgaggaatacttccaccactgg

SEQ ID NO: 3533 - DNA, 48 bp, Artificial Sequence; identical to SEQ ID NO: 1771
  Synthetic construct

SEQ ID NO: 3534 - DNA, 66 bp, Artificial Sequence
  Synthetic construct
tgtgcgagagatgggtcttgtgattacatttgggggggttatcgttatgatgcttttgatatttgg

SEQ ID NO: 3535 - DNA, 57 bp, Artificial Sequence
  Synthetic construct
tgtgcgagccatccttatgggaggtatagcagtggctggggggcctttgactactgg

SEQ ID NO: 3536 - DNA, 66 bp, Artificial Sequence
  Synthetic construct
tgtgcgagacagcgaagcgagtggatagtagtggttattacgggctactactacatggacgtctgg

SEQ ID NO: 3537 - DNA, 72 bp, Artificial Sequence
  Synthetic construct
tgtgcgagagatcgcggacaccccaattactatggttcggggagttattaccgctactactttgactactgg

SEQ ID NO: 3538 - DNA, 39 bp, Artificial Sequence
  Synthetic construct
tgtgcgcgacggtcgtatagtggctactttgactcctgg

SEQ ID NO: 3539 - DNA, 36 bp, Artificial Sequence
  Synthetic construct
tgtgcgaccctgaagtggaattccttagactcctgg

SEQ ID NO: 3540 - DNA, 57 bp, Artificial Sequence
  Synthetic construct
tgtaccacagggttcgattttggagtggttattattgtcgatggcatggacgtctgg

SEQ ID NO: 3541 - DNA, 69 bp, Artificial Sequence
  Synthetic construct
tgtaccacagtcccttattgtagtggtggtagctgctacggggactactactactacatggacgtctgg

SEQ ID NO: 3542 - DNA, 60 bp, Artificial Sequence
  Synthetic construct
tgtaccacctcaatcgaattactatggttcggggagcccctcggcgcttttgatatctgg

SEQ ID NO: 3543 - DNA, 51 bp, Artificial Sequence
  Synthetic construct
tgtaccactttacggtcaggggactactacttctactacatggacgtctgg

SEQ ID NO: 3544 - DNA, 48 bp, Artificial Sequence
  Synthetic construct
tgtaccacagagggcggcagtggctggtttgggtactttgactactgg

SEQ ID NO: 3545 - DNA, 30 bp, Artificial Sequence
  Synthetic construct
tgtagtagagactggggcattgcactctgg

SEQ ID NO: 3546 - DNA, 66 bp, Artificial Sequence
  Synthetic construct
tgtgcgaaagatgggggaagaacgtcttactatgatactagtgcttattactactttgactactgg

SEQ ID NO: 3547 - DNA, 69 bp, Artificial Sequence
  Synthetic construct
tgtgcgagagaagatcgtggatattgtagtagtggtagctgctactttgtagggacctttgactactgg

SEQ ID NO: 3548 - DNA, 33 bp, Artificial Sequence
  Synthetic construct
tgtgcgcgagggtcccgggaggttctctactgg

SEQ ID NO: 3549 - DNA, 60 bp, Artificial Sequence
  Synthetic construct
tgtgcgagaggaggggcccattattgtggtggtgactgcccgagggcttttgacatctgg

SEQ ID NO: 3550 - DNA, 39 bp, Artificial Sequence
  Synthetic construct
tgtgcgagtctctggtcccgttactactttgacttctgg

SEQ ID NO: 3551 - DNA, 48 bp, Artificial Sequence
  Synthetic construct
tgtgcgagagcgacgggtgggaccttctactaccatatggacgtctgg

SEQ ID NO: 3552 - DNA, 87 bp, Artificial Sequence
  Synthetic construct
tgtgtaaaacaggctctgaatactgggtacgattcgactttttcaccctttgtctctatctactactacttctacatggacgtctgg

SEQ ID NO: 3553 - DNA, 54 bp, Artificial Sequence
  Synthetic construct
tgtgggagactctgccaggcgttttggtccggggaacattgtggggactcctgg

SEQ ID NO: 3554 - DNA, 63 bp, Artificial Sequence
  Synthetic construct
tgtgcgacacacgtctcgctccattgtggttctaattgctattcggaatatttccatcactgg

SEQ ID NO: 3555 - DNA, 39 bp, Artificial Sequence
  Synthetic construct
tgtatttcggctgctacggatgagctctttgagtactgg

SEQ ID NO: 3556 - DNA, 60 bp, Artificial Sequence
  Synthetic construct
tgttcaaagaatcagtttgatagtagtggttattacttaggaggggcttttgatatctgg

SEQ ID NO: 3557 - DNA, 60 bp, Artificial Sequence
  Synthetic construct
tgtgcgaaaaccacgacgttttattatgataatagtgacctttttgcttttgatatctgg

SEQ ID NO: 3558 - DNA, 51 bp, Artificial Sequence
  Synthetic construct
tgtgcgagagaggcaggtggctggtcctctcacaactggttcgacccctgg

SEQ ID NO: 3559 - DNA, 39 bp, Artificial Sequence
  Synthetic construct
tgtgcgagagaagggcattccgaaggttttgatatttgg

SEQ ID NO: 3560 - DNA, 69 bp, Artificial Sequence
  Synthetic construct
tgtaccacaggactaggaagcgatgataatagtgattattttatgaacattgatggttttaatatctgg

SEQ ID NO: 3561 - DNA, 57 bp, Artificial Sequence
  Synthetic construct
tgtgcgagagtttttaggactggagactattggaggggacttctgtgggactactgg

SEQ ID NO: 3562 - DNA, 87 bp, Artificial Sequence
  Synthetic construct
tgcgcggctcatctgaggggggcgacagatggcggtttttggagtggccttgcgcgtttgaagtcctgggggtggctcgacccctgg

SEQ ID NO: 3563 - DNA, 57 bp, Artificial Sequence
  Synthetic construct
tgtaccacagattttcggttcgatgacagtggttactacaactacttagataactgg

SEQ ID NO: 3564 - DNA, 57 bp, Artificial Sequence
  Synthetic construct
tgtgcgaaagagggtggacgtggatatagttccttcgataattactttgactattgg

SEQ ID NO: 3565 - DNA, 36 bp, Artificial Sequence
  Synthetic construct
tgtgcgagaaatagtgcccagccctttgactcctgg

SEQ ID NO: 3566 - DNA, 69 bp, Artificial Sequence
  Synthetic construct
tgtgcgagagatatcgcccctcattactatgatagtagtgcttattcacccgatgcttttgatatctgg

SEQ ID NO: 3567 - DNA, 48 bp, Artificial Sequence
  Synthetic construct
tgtgcgaaacggcaggggtatagtagctcgtccccgttggggtcctgg

SEQ ID NO: 3568 - DNA, 48 bp, Artificial Sequence
  Synthetic construct
tgtgcgaaacgacaggggtatagtagctcgtccccgttggggtcctgg

SEQ ID NO: 3569 - DNA, 57 bp, Artificial Sequence
  Synthetic construct
tgcgcgagagtcggctgtagtggtgatcattgctatggatattactttgactactgg

SEQ ID NO: 3570 - DNA, 39 bp, Artificial Sequence
  Synthetic construct
tgtgcaaccctctctgcccctgttatctcccgtcactgg

SEQ ID NO: 3571 - DNA, 51 bp, Artificial Sequence
  Synthetic construct
tgtgcgagagggcgcagtgactggttgactggaggaggttttgatatttgg

SEQ ID NO: 3572 - DNA, 42 bp, Artificial Sequence
  Synthetic construct
tgtgcaagagaggactacggtggtaaaccccaggcctactgg

SEQ ID NO: 3573 - DNA, 39 bp, Artificial Sequence
  Synthetic construct
tgtgcgagaggtttgtccgcagtggctggttcggggtgg

SEQ ID NO: 3574 - DNA, 54 bp, Artificial Sequence
  Synthetic construct
tgtgcgcgagttcagcatgatagtagtggttattattctggccttgacttctgg

SEQ ID NO: 3575 - DNA, 60 bp, Artificial Sequence
  Synthetic construct
tgtgcgaggcgatacaccggtgcctggtcctacttcacgtaccactacttggacgtctgg

SEQ ID NO: 3576 - DNA, 57 bp, Artificial Sequence
  Synthetic construct
tgtgcgaaaccgcgggtgaactttggttcggggagaggagacgattttgatatctgg

SEQ ID NO: 3577 - DNA, 51 bp, Artificial Sequence
  Synthetic construct
tgtgcgagaaattttggagtgattcttataggagatgcctttgatctctgg

SEQ ID NO: 3578 - DNA, 63 bp, Artificial Sequence
  Synthetic construct
tgtgtcagaggcgattcagttcacttcgataggaatgcatattatgggggatttgatgtctgg

SEQ ID NO: 3579 - DNA, 54 bp, Artificial Sequence
  Synthetic construct
tgtgcgagagatccccctagtgagtgggaggtaacgttctactttgactactgg

SEQ ID NO: 3580 - DNA, 60 bp, Artificial Sequence
  Synthetic construct
tgtgcgagagacggtgcgtccatttttatcgaagtaattaatttctacatggacgtctgg

SEQ ID NO: 3581 - DNA, 51 bp, Artificial Sequence
  Synthetic construct
tgtgcgcgccggttttgtagtggtggtagctgctactctcttgaatattgg

SEQ ID NO: 3582 - DNA, 51 bp, Artificial Sequence
  Synthetic construct
tgtgtgaaggattcgggttcggggaggatcatttccctgcttgacttctgg

SEQ ID NO: 3583 - DNA, 48 bp, Artificial Sequence
  Synthetic construct
tgtgcgagaggtcccggatacagctatgacatccagtttgactactgg

SEQ ID NO: 3584 - DNA, 48 bp, Artificial Sequence
  Synthetic construct
tgtgcgagaagtcacggagatggctacaattcttactttgactactgg

SEQ ID NO: 3585 - DNA, 45 bp, Artificial Sequence
  Synthetic construct
tgtgcgaaagactattatggttcggggagttattgcgactactgg

SEQ ID NO: 3586 - DNA, 72 bp, Artificial Sequence
  Synthetic construct
tgtgcgagagccaacacctattactttacctcggggacttattataacaatgacgactaccttgactcctgg

SEQ ID NO: 3587 - DNA, 48 bp, Artificial Sequence
  Synthetic construct
tgtggaagagattttgggagatggccgcccaggggacttgactactgg

SEQ ID NO: 3588 - DNA, 45 bp, Artificial Sequence
  Synthetic construct
tgtgcgaaagacatgtttgatattagtggtctcaatgactactgg

SEQ ID NO: 3589 - DNA, 48 bp, Artificial Sequence
  Synthetic construct
tgtgcgaaagatcgggatgactacggtgactactactttgactactgg

SEQ ID NO: 3590 - DNA, 51 bp, Artificial Sequence
  Synthetic construct
tgtgcgagagcccaaacccattactatgatagtagagggtttggcgactgg

SEQ ID NO: 3591 - DNA, 48 bp, Artificial Sequence
  Synthetic construct
tgtgcgagagatcggtttgtagaggctacgaccacggcggacttctgg

SEQ ID NO: 3592 - DNA, 66 bp, Artificial Sequence
  Synthetic construct
tatgcgagagtggagaggacaccctcatccggggcactctactactactactacatggacgtctgg

SEQ ID NO: 3593 - DNA, 63 bp, Artificial Sequence
  Synthetic construct
tgtgcgaaagagggtggatatagtggctacggttactactactactactacatggacgtctgg

SEQ ID NO: 3594 - DNA, 48 bp, Artificial Sequence
  Synthetic construct
tgtgcgaaagatccgaactcgggcagcagtggccaccttgactactgg

SEQ ID NO: 3595 - DNA, 51 bp, Artificial Sequence
  Synthetic construct
tgtgcgaaagatgtggttcggggagttgactactactacatggacgtctgg

SEQ ID NO: 3596 - DNA, 66 bp, Artificial Sequence
  Synthetic construct
tgtgcgagagatcggagtagttactatgatagtagtggttattacctaaactggttcgacccctgg

SEQ ID NO: 3597 - DNA, 60 bp, Artificial Sequence
  Synthetic construct
tgtgcgagagattactgtagtagtaccagctgccctttctactactacatggacgtctgg

SEQ ID NO: 3598 - DNA, 66 bp, Artificial Sequence
  Synthetic construct
tgtgcgagagctcacggcgaaggatattgtactaatggtgtatgttcctcctactttgactactgg

SEQ ID NO: 3599 - DNA, 39 bp, Artificial Sequence
  Synthetic construct
tgtgcgaaagacgccaatggtggctggtatgactactgg

SEQ ID NO: 3600 - DNA, 42 bp, Artificial Sequence
  Synthetic construct
tgtgcgttctttccctcgggcagttatgcctttcacatttgg

SEQ ID NO: 3601 - DNA, 63 bp, Artificial Sequence
  Synthetic construct
tgtgcaagggatcagtattactctgaaactactgcttattacttcaaatacttccaacactgg

SEQ ID NO: 3602 - DNA, 63 bp, Artificial Sequence
  Synthetic construct
tgtgcgaaagtcggttatggtatcagttggtacttgggctactactactacatggacgactgg

SEQ ID NO: 3603 - DNA, 63 bp, Artificial Sequence
  Synthetic construct
tgtgcgagagctttcgggaatttttttgattggtcctcccgggactattacatggacgtctgg

SEQ ID NO: 3604 - DNA, 45 bp, Artificial Sequence
  Synthetic construct
tgtgcgcgagggggggcctacgaaatgacctggtttgacacctgg

SEQ ID NO: 3605 - DNA, 60 bp, Artificial Sequence
  Synthetic construct
tgtgcgcgagatcatatggtgtctgcttcctcctacaactccttctacatggacgtctgg

SEQ ID NO: 3606 - DNA, 48 bp, Artificial Sequence
  Synthetic construct
tgtgcgagcatgaccatggttcggacgaataactggttcgacctctgg

SEQ ID NO: 3607 - DNA, 54 bp, Artificial Sequence
  Synthetic construct
tgtgcgacagataggcattcctatcattcggggagttttgttcttgacttctgg

SEQ ID NO: 3608 - DNA, 48 bp, Artificial Sequence
  Synthetic construct
tgcgcgaaaaagtttggccgcggactgtctgatgtttttgatatgtgg

SEQ ID NO: 3609 - DNA, 33 bp, Artificial Sequence
  Synthetic construct
tgtgcgctatattggaattatgtcctcgagtgg

SEQ ID NO: 3610 - DNA, 51 bp, Artificial Sequence
  Synthetic construct
tgtactagacatctggatttcaatagtgacccgtcggggggggactactgg

SEQ ID NO: 3611 - DNA, 51 bp, Artificial Sequence
  Synthetic construct
tgtgcaaaatccccctcccctgaggtgggaactacaccctttgactactgg

SEQ ID NO: 3612 - DNA, 51 bp, Artificial Sequence
  Synthetic construct
tgtgcaaaggacctagcagcagctggcacttatgatgcttttgaaaaatgg

SEQ ID NO: 3613 - DNA, 48 bp, Artificial Sequence
  Synthetic construct
tgtgtaaaagatctcgcgagcggtatggttcagggttttgatatctgg

SEQ ID NO: 3614 - DNA, 60 bp, Artificial Sequence
  Synthetic construct
tgtgcaaaagattcccacccttcttatggttcggggagttgggatgcttttgatatctgg

SEQ ID NO: 3615 - DNA, 57 bp, Artificial Sequence
  Synthetic construct
tgtgcaagagatataaacccctatagcagtggctgggtgtcctactttgactactgg

SEQ ID NO: 3616 - DNA, 63 bp, Artificial Sequence
  Synthetic construct
tgtgcaaaggataggggattacgtttgggggagttatcgcggggtcactactttgacttgtgg

SEQ ID NO: 3617 - DNA, 45 bp, Artificial Sequence
  Synthetic construct
tgtgcaaaagacagtagtggatataatgatgcttttgagatctgg

SEQ ID NO: 3618 - DNA, 45 bp, Artificial Sequence
  Synthetic construct
tgtgtgaaagataaaacccgtggccatcagtacttccaacactgg

SEQ ID NO: 3619 - DNA, 42 bp, Artificial Sequence
  Synthetic construct
tgtgcaaaagatgagggatttttgactggtttttctcattgg

SEQ ID NO: 3620 - DNA, 48 bp, Artificial Sequence
  Synthetic construct
tgtgcaacaccctcgcgtagggggtggttattatgggttgactactgg

SEQ ID NO: 3621 - DNA, 42 bp, Artificial Sequence
  Synthetic construct
tgtgcaacagaaggatatagtggctacgactttgactactgg

SEQ ID NO: 3622 - DNA, 30 bp, Artificial Sequence
  Synthetic construct
tgtgcaacagatacccctattcgggagtgg

SEQ ID NO: 3623 - DNA, 45 bp, Artificial Sequence
  Synthetic construct
tgtgcaacagatcagggtagtggttattactactttgactactgg

SEQ ID NO: 3624 - DNA, 42 bp, Artificial Sequence
  Synthetic construct
tgtgcaacagccaacattggggctattactatagcctactgg

SEQ ID NO: 3625 - DNA, 39 bp, Artificial Sequence
  Synthetic construct
tgtgcaacagccgctagtagtggttattttttctactgg

SEQ ID NO: 3626 - DNA, 66 bp, Artificial Sequence
  Synthetic construct
tgtgcaacagcgggtggttacgatattttgactggttattatagccccggtgcttttgatatctgg

SEQ ID NO: 3627 - DNA, 54 bp, Artificial Sequence
  Synthetic construct
tgtgcaactgtaactactgggaggggctactactactactacatggacgtctgg

SEQ ID NO: 3628 - DNA, 45 bp, Artificial Sequence
  Synthetic construct
tgtgcaaggaggcattacgatattttgacttcggtcgacccctgg

SEQ ID NO: 3629 - DNA, 42 bp, Artificial Sequence
  Synthetic construct
tgtgcaatggttatggctacaatgaggagggttgactactgg

SEQ ID NO: 3630 - DNA, 42 bp, Artificial Sequence
  Synthetic construct
tgtgcgacgcacttcgacggctacaatctacccgactactgg

SEQ ID NO: 3631 - DNA, 39 bp, Artificial Sequence
  Synthetic construct
tgtgtgaccctctctgcccctgttacctcacgccagtgg

SEQ ID NO: 3632 - DNA, 60 bp, Artificial Sequence
  Synthetic construct
tgtgcgagagcctcaggtggatatagtggctacgaccaatggtactactttgactactgg

SEQ ID NO: 3633 - DNA, 42 bp, Artificial Sequence
  Synthetic construct
tgtctgttactggaaggtttgacagcaacttctactgactgg

SEQ ID NO: 3634 - DNA, 54 bp, Artificial Sequence
  Synthetic construct
tgtgcgagatgcgaaattttgaccggttattatagttgccacttcgactcctgg

SEQ ID NO: 3635 - DNA, 57 bp, Artificial Sequence
  Synthetic construct
tgtgcgagattgaatggtgactacgaagaggggaactactactacatggacgtctgg

SEQ ID NO: 3636 - DNA, 42 bp, Artificial Sequence
  Synthetic construct
tgtgcgagtggggttgatacagcctatgcttttgatatctgg

SEQ ID NO: 3637 - DNA, 60 bp, Artificial Sequence
  Synthetic construct
tgtgtgagagaaagggcccttcggcctaatatagcagctcgtggaccctttgactactgg

SEQ ID NO: 3638 - DNA, 54 bp, Artificial Sequence
  Synthetic construct
tgtgcgagagataatcagttgaggagcagcacactatggggctttgactactgg

SEQ ID NO: 3639 - DNA, 42 bp, Artificial Sequence
  Synthetic construct
tgtgcggcggtcagggggagcttctttcaccttcaccactgg

SEQ ID NO: 3640 - DNA, 57 bp, Artificial Sequence
  Synthetic construct
tgtgtgagagatctctggtcgatctacggtgacttcatcaagggatttgtcgactgg

SEQ ID NO: 3641 - DNA, 36 bp, Artificial Sequence
  Synthetic construct
tgtgcgagagcatacaattattcttgtggattctgg

SEQ ID NO: 3642 - DNA, 54 bp, Artificial Sequence
  Synthetic construct
tgtgtgataggccgagcagcaggtggaaggggcactgacgcttttgcgatctgg

SEQ ID NO: 3643 - DNA, 51 bp, Artificial Sequence
  Synthetic construct
tgtgcaacagatctactatggttcggggagcgtgatgcttttgatatctgg

SEQ ID NO: 3644 - DNA, 36 bp, Artificial Sequence
  Synthetic construct
tgtgcaacttgggagcagggctggtcggtctactgg

SEQ ID NO: 3645 - DNA, 63 bp, Artificial Sequence
  Synthetic construct
tgtacgagagttcgacttcgtatagatgcaataggggcccgcagcaactggttcgacccctgg

SEQ ID NO: 3646 - DNA, 45 bp, Artificial Sequence
  Synthetic construct
tgtgcggcagtctcccaccagtctggtggtgcttttgatatctgg

SEQ ID NO: 3647 - DNA, 42 bp, Artificial Sequence
  Synthetic construct
tgtgcgagagaccatgggagcgactggtacttcgatctctgg

SEQ ID NO: 3648 - DNA, 48 bp, Artificial Sequence
  Synthetic construct
tgtgcgagagaaataactgagttttactatggttcgggggactactgg

SEQ ID NO: 3649 - DNA, 60 bp, Artificial Sequence
  Synthetic construct
tgtgcgagagatcggctctgtagtggtggtagctgctactccgggtggttcgacccctgg

SEQ ID NO: 3650 - DNA, 54 bp, Artificial Sequence
  Synthetic construct
tgtgcgagagatccaaccccttactatgaggggggttggtacttcgatctctgg

SEQ ID NO: 3651 - DNA, 48 bp, Artificial Sequence
  Synthetic construct
tgtgcgagaaacctagattactatggtttgggggagttcgacccctgg

SEQ ID NO: 3652 - DNA, 42 bp, Artificial Sequence
  Synthetic construct
tgtgcaacactggcggttcgaagagtcccacgcccgtactgg

SEQ ID NO: 3653 - DNA, 42 bp, Artificial Sequence
  Synthetic construct
tgtgtgcgagcgcaccgggggagcccctactttgactcctgg

SEQ ID NO: 3654 - DNA, 51 bp, Artificial Sequence
  Synthetic construct
tgtgctagagcctctgggggatctacagtccaccgctactatgactactgg

SEQ ID NO: 3655 - DNA, 51 bp, Artificial Sequence
  Synthetic construct
tgtgttaaagatggagacagcaacaccgcatacttccactttgacacttgg

SEQ ID NO: 3656 - DNA, 63 bp, Artificial Sequence
  Synthetic construct
tgtactagagcctcttactgtattaatggaagatgcacgtcacctggcccctttgacttctgg

SEQ ID NO: 3657 - DNA, 57 bp, Artificial Sequence
  Synthetic construct
tgtgccagagggggcttccatgacgaataccgggccctttcgccctttgacttctgg

SEQ ID NO: 3658 - DNA, 66 bp, Artificial Sequence
  Synthetic construct
tgtgcgagagaccgccttcatgacccatccgcggtgcgcttttttgactggtcgtttgacaagtgg

SEQ ID NO: 3659 - DNA, 57 bp, Artificial Sequence
  Synthetic construct
tgtgcgagaatgtcttattacgatggaagtggttactacttcttctttgaccactgg

SEQ ID NO: 3660 - DNA, 54 bp, Artificial Sequence
  Synthetic construct
tgtgcgacagcgggggcccacagtaatggtttctattacggctttgagtcctgg

SEQ ID NO: 3661 - DNA, 54 bp, Artificial Sequence
  Synthetic construct
tgtgcgaggttccccataacacctactgctaactattactacatggacgtctgg

SEQ ID NO: 3662 - DNA, 42 bp, Artificial Sequence
  Synthetic construct
tgtgtgaaatatggtgcacaggaatggttaggggagtcttgg

SEQ ID NO: 3663 - DNA, 60 bp, Artificial Sequence
  Synthetic construct
tgtgcgagagggttcgacgcttatgattttttgcctggctctccctactttgactactgg

SEQ ID NO: 3664 - DNA, 54 bp, Artificial Sequence
  Synthetic construct
tgtgcgagactagtggagaggttctccccccacactttctactttcactactgg

SEQ ID NO: 3665 - DNA, 69 bp, Artificial Sequence
  Synthetic construct
tgtgcaagagatcgatctccccttattaagatttttggagtgcttatgggctcctacatggacgtctgg

SEQ ID NO: 3666 - DNA, 42 bp, Artificial Sequence; identical to SEQ ID NO: 1770
  Synthetic construct

SEQ ID NO: 3667 - DNA, 33 bp, Artificial Sequence
  Synthetic construct
tgtgcgagagtcctatttggggggcccctgtgg

SEQ ID NO: 3668 - DNA, 51 bp, Artificial Sequence
  Synthetic construct
tgtgcgcgcggtctcagtcccaactggtacttcgatgcttttgacatatgg

SEQ ID NO: 3669 - DNA, 36 bp, Artificial Sequence
  Synthetic construct
tgtgcgaaagaatttagaggagcttttgatatctgg

SEQ ID NO: 3670 - DNA, 54 bp, Artificial Sequence
  Synthetic construct
tgtgcgaggagacacagtggcgacgattcgcccagctacttctttgactactgg

SEQ ID NO: 3671 - DNA, 51 bp, Artificial Sequence
  Synthetic construct
tgcacgagaggccgatacccccgcatgcttcgcaggcactttgacttctgg

SEQ ID NO: 3672 - DNA, 54 bp, Artificial Sequence
  Synthetic construct
tgtgcgacccgaagacggatgttttcgaccaatgtcgattcttatgatatctgg

SEQ ID NO: 3673 - DNA, 51 bp, Artificial Sequence
  Synthetic construct
tgtgcggcagtccctgggggcctcttaattcgcgaaacgttcgagtcgtgg

SEQ ID NO: 3674 - DNA, 45 bp, Artificial Sequence
  Synthetic construct
tgtacaacagcccggggccgctggacctaccactttgcgtcctgg

SEQ ID NO: 3675 - DNA, 57 bp, Artificial Sequence
  Synthetic construct
tgtgcaagagcggcgatttttggagtggttttttgggaaaactatttcgacccctgg

SEQ ID NO: 3676 - DNA, 33 bp, Artificial Sequence
  Synthetic construct
tgtgcgagatatgagtatgatcttgactactgg

SEQ ID NO: 3677 - DNA, 69 bp, Artificial Sequence
  Synthetic construct
tgtgcaacagagggggtcggaaggactaataaagcaggtgttggttgggatgatgcttttgatatctgg

SEQ ID NO: 3678 - DNA, 66 bp, Artificial Sequence
  Synthetic construct
tgtgcgaaatctaaaacccatactttttatcctggttcgggaggtcccacttacatcgacgactgg

SEQ ID NO: 3679 - DNA, 54 bp, Artificial Sequence
  Synthetic construct
tgcgcgagagtgatggaaacagccatggcccccgactactacatggacgtctgg

SEQ ID NO: 3680 - DNA, 57 bp, Artificial Sequence
  Synthetic construct
tgtgcgagcgcgaactggactgcggtgatttcaacaaccgataccctccatgtctgg

SEQ ID NO: 3681 - DNA, 48 bp, Artificial Sequence
  Synthetic construct
tgtgcgaaggtgctgctgggagctcttaccgatgctttcgatatctgg

SEQ ID NO: 3682 - DNA, 54 bp, Artificial Sequence; identical to SEQ ID NO: 1773
  Synthetic construct

SEQ ID NO: 3683 - DNA, 72 bp, Artificial Sequence
  Synthetic construct
tgtgcaacctcccctaagtttgatgataacgcctgggggacttttcgtgatacggccacacctgactactgg

SEQ ID NO: 3684 - DNA, 54 bp, Artificial Sequence
  Synthetic construct
tgtgccagaggcgataggtcgataatagtaggtcaattttacatggacgtctgg

SEQ ID NO: 3685 - DNA, 51 bp, Artificial Sequence
  Synthetic construct
tgtgcgcgatgtaaggccgaatatacgactggttgccccggggactattgg

SEQ ID NO: 3686 - DNA, 45 bp, Artificial Sequence
  Synthetic construct
tgtgcgcgacggttttattcttatggttttgcctttgatatctgg

SEQ ID NO: 3687 - DNA, 63 bp, Artificial Sequence
  Synthetic construct
tgtgcgagaggttggggtatatcgattggtggagcgacaaccaccaagtggctccacccctgg

SEQ ID NO: 3688 - DNA, 66 bp, Artificial Sequence
  Synthetic construct
tgtgcgagagagggggcaggctattactatgatagcagtggcctgggatatggctttgatatctgg

SEQ ID NO: 3689 - DNA, 42 bp, Artificial Sequence
  Synthetic construct
tgtgcgagagctgatagcaccgactggcaaatggactactgg

SEQ ID NO: 3690 - DNA, 39 bp, Artificial Sequence
  Synthetic construct
tgtgcgagacgatatggcttcactcccctcgacttctgg

SEQ ID NO: 3691 - DNA, 63 bp, Artificial Sequence
  Synthetic construct
tgtgcgagagataatcggccttattatgatatgagtgggtattcacctgaccttgactactgg

SEQ ID NO: 3692 - DNA, 51 bp, Artificial Sequence
  Synthetic construct
tgtgcgagagagacgtggggattccttggagggggctactttgactattgg

SEQ ID NO: 3693 - DNA, 48 bp, Artificial Sequence
  Synthetic construct
tgtgcgaaatatcgcccaggacctaagaatgatgctttgcatgtctgg

SEQ ID NO: 3694 - DNA, 42 bp, Artificial Sequence
  Synthetic construct
tgtgcgcgaatttattatagtgggacgtaccaagactactgg

SEQ ID NO: 3695 - DNA, 66 bp, Artificial Sequence
  Synthetic construct
tgtactcgagataaaggaatgtatgactggaactccgggacctacctctactacatggacgcctgg

SEQ ID NO: 3696 - DNA, 57 bp, Artificial Sequence; identical to SEQ ID NO: 1769
  Synthetic construct

SEQ ID NO: 3697 - DNA, 36 bp, Artificial Sequence
  Synthetic construct
tgcaccgtccacattggcaccagcgctaacttctgg

SEQ ID NO: 3698 - DNA, 66 bp, Artificial Sequence
  Synthetic construct
tgtactagagatcgaggaacgtatgactggaactacgggacctacttctactacatggaagtctgg

SEQ ID NO: 3699 - DNA, 54 bp, Artificial Sequence
  Synthetic construct
tgtgcgagagggggacgcacctttggttatacgtgggagttctttgacaactgg

SEQ ID NO: 3700 - DNA, 54 bp, Artificial Sequence
  Synthetic construct
tgtgcgagagagagaagtccgagagtcgactactaccactacatggacgtctgg

SEQ ID NO: 3701 - DNA, 42 bp, Artificial Sequence
  Synthetic construct
tgtgcacacagtccaacatattccaacatctttgacttctgg

SEQ ID NO: 3702 - DNA, 54 bp, Artificial Sequence
  Synthetic construct
tgtgtaagagcatattgtagtagtagcagctgcccaggcggttttgacttctgg

SEQ ID NO: 3703 - DNA, 42 bp, Artificial Sequence
  Synthetic construct
tgtgcgaagggccgtgcaaattggcgatactttgacctctgg

SEQ ID NO: 3704 - DNA, 51 bp, Artificial Sequence
  Synthetic construct
tgtgcgagaattagagtcggggaattatttttcggcacctttgacttctgg

SEQ ID NO: 3705 - DNA, 63 bp, Artificial Sequence
  Synthetic construct
tgtgcgagaggacgttttcagagagtgggaggcgtctacacctacttctacatggacgtctgg

SEQ ID NO: 3706 - DNA, 51 bp, Artificial Sequence
  Synthetic construct
tgtgtgaactccttcaaatacaggagcaacccgggggacttcggctcctgg

SEQ ID NO: 3707 - DNA, 63 bp, Artificial Sequence
  Synthetic construct
tgtgcgagaggttggggtattacgatttctggagcgtctaccagcaagtggctccacccctgg

SEQ ID NO: 3708 - DNA, 78 bp, Artificial Sequence
  Synthetic construct
tgtgcgagatttggctctccaactctccttattgactacggtgactacgaaaaggtgatcggtgctttggatgtctgg

SEQ ID NO: 3709 - DNA, 69 bp, Artificial Sequence
  Synthetic construct
tgtgcgagaggtcacagaatatattatgatattagaagttattacggagagtcctggctcgacccctgg

SEQ ID NO: 3710 - DNA, 42 bp, Artificial Sequence
  Synthetic construct
tgtgcacggatgctggcccgacagaattacttcgacccctgg

SEQ ID NO: 3711 - DNA, 54 bp, Artificial Sequence
  Synthetic construct
tgtgcacggattctggaccctcattactatggttcgggggctattgactactgg

SEQ ID NO: 3712 - DNA, 57 bp, Artificial Sequence
  Synthetic construct
tgctcgacagatgcttccaatgattacacctgggggagttatcgcctagaccactgg

SEQ ID NO: 3713 - DNA, 63 bp, Artificial Sequence
  Synthetic construct
tgtgcgagagatggtctttattgtagtaggagtggctgtttcgcggactggctcgacctctgg

SEQ ID NO: 3714 - DNA, 42 bp, Artificial Sequence
  Synthetic construct
tgtgtgagactgactgcggtgactcactactttgactactgg

SEQ ID NO: 3715 - DNA, 51 bp, Artificial Sequence
  Synthetic construct
tgtgcgaggccccggaggagtggctacaattatgttggttttgatgtctgg

SEQ ID NO: 3716 - DNA, 48 bp, Artificial Sequence
  Synthetic construct
tgtgcggtggccgcttacccggggagaggtaggcgtctcgacccctgg

SEQ ID NO: 3717 - DNA, 33 bp, Artificial Sequence
  Synthetic construct
tgtgccagaggagttcgatattacgccccctgg

SEQ ID NO: 3718 - DNA, 45 bp, Artificial Sequence
  Synthetic construct
tgtactagtccctcggggagttattaccccctcccctactactgg

SEQ ID NO: 3719 - DNA, 75 bp, Artificial Sequence
  Synthetic construct
tgtgtacgggtaaaatattacgatgttgtgactggccatcctacggcctaccattcctactacatggacgtctgg

SEQ ID NO: 3720 - DNA, 51 bp, Artificial Sequence
  Synthetic construct
tgtgcacgggcggcgtgtagtggttattactactactacatggacgtctgg

SEQ ID NO: 3721 - DNA, 57 bp, Artificial Sequence
  Synthetic construct
tgtgcacggatcccacccaacacacagctatgggccaattactactttgactactgg

SEQ ID NO: 3722 - DNA, 48 bp, Artificial Sequence
  Synthetic construct
tgtgcacggtcatttctgcctacatccagttattcttttgacttctgg

SEQ ID NO: 3723 - DNA, 72 bp, Artificial Sequence
  Synthetic construct
tgcgcacggacactggttactaatgtggcagcagctgggaattactactaccactactacatggacgtctgg

SEQ ID NO: 3724 - DNA, 51 bp, Artificial Sequence
  Synthetic construct
tgtgcacggataaggtactatggttcggggagttgttactttgactactgg

SEQ ID NO: 3725 - DNA, 39 bp, Artificial Sequence
  Synthetic construct
tgtacacggcctgagaggaacgggcagatcgactactgg

SEQ ID NO: 3726 - DNA, 42 bp, Artificial Sequence
  Synthetic construct
tgtgcacggaattcgaggcgggagagctttttcgacccctgg

SEQ ID NO: 3727 - DNA, 60 bp, Artificial Sequence
  Synthetic construct
tgtgttagagaggccccttcttactatgatgccagtggttatttctactttgactactgg

SEQ ID NO: 3728 - DNA, 51 bp, Artificial Sequence
  Synthetic construct
tgtgcacgggaggattttgatagtggaggttatcatgcatttgatatctgg

SEQ ID NO: 3729 - DNA, 51 bp, Artificial Sequence
  Synthetic construct
tgtgcgaaggatcgtgacatggccacactttggggacacttccaacactgg

SEQ ID NO: 3730 - DNA, 57 bp, Artificial Sequence
  Synthetic construct
tgtgcacggatgcgggtagtcgggtccggttcggggactcgttactttgactactgg

SEQ ID NO: 3731 - DNA, 39 bp, Artificial Sequence
  Synthetic construct
tgtgcacaatcctacgtttcggggagtatcaaatcctgg

SEQ ID NO: 3732 - DNA, 63 bp, Artificial Sequence
  Synthetic construct
tgtgcacacagaattgcgagtcgtaatggcttgaacctctatattgatgcttttgatttttgg

SEQ ID NO: 3733 - DNA, 54 bp, Artificial Sequence
  Synthetic construct
tgcgcacacagtcgctattactatactttgggttcctggtactttgactactgg

SEQ ID NO: 3734 - DNA, 33 bp, Artificial Sequence
  Synthetic construct
tgtgcacacaatggcctcccctttgactgctgg

SEQ ID NO: 3735 - DNA, 60 bp, Artificial Sequence
  Synthetic construct
tgtgcacaccgaggacgatattgtagtggtaccggctgtgggtactactttgactactgg

SEQ ID NO: 3736 - DNA, 51 bp, Artificial Sequence
  Synthetic construct
tgtgcattcagcccgcgaggtgtttattatgaatatttctttgaccactgg

SEQ ID NO: 3737 - DNA, 42 bp, Artificial Sequence
  Synthetic construct
tgtgtgtacagtatatatgggtcggggatttttgggtactgg

SEQ ID NO: 3738 - DNA, 63 bp, Artificial Sequence
  Synthetic construct
tgtgcacacaacgccaaccgtctgtatttctatgatagtggtcccacattctttgactactgg

SEQ ID NO: 3739 - DNA, 60 bp, Artificial Sequence
  Synthetic construct
tgtacaaaattcgcaacatattactatgatactcctggtcatgaacaccttgactcctgg

SEQ ID NO: 3740 - DNA, 60 bp, Artificial Sequence
  Synthetic construct
tgtgcgaggacccttataattggaagtacttatgaacctgaatattacatggacgtctgg

SEQ ID NO: 3741 - DNA, 36 bp, Artificial Sequence
  Synthetic construct
tgtgcgctcttccctagtggcaactacgactactgg

SEQ ID NO: 3742 - DNA, 81 bp, Artificial Sequence
  Synthetic construct
tgtgcaagagatctctgggtagatattatgagtacgtttgggggacgtatcgccatgacggatggggcttttgatatctgg

SEQ ID NO: 3743 - DNA, 57 bp, Artificial Sequence
  Synthetic construct
tgcgccagcggatattgtagcggtggaagatgctacggggaattcctccagcactgg

SEQ ID NO: 3744 - DNA, 66 bp, Artificial Sequence
  Synthetic construct
tgtgcgcgagataaaagggaggtattggttttcagagcaggcactggttcgggattcgacccctgg

SEQ ID NO: 3745 - DNA, 60 bp, Artificial Sequence
  Synthetic construct
tgttcgagagggaccaaggggggggtcagcccacactcctactactacgtggacgtctgg

SEQ ID NO: 3746 - DNA, 42 bp, Artificial Sequence
  Synthetic construct
tgtgcgagagccctgtatgacagcaacccgtttgactactgg

SEQ ID NO: 3747 - DNA, 48 bp, Artificial Sequence
  Synthetic construct
tgtgcgagagcccgccattattatgggtcggggagttttgactcctgg

SEQ ID NO: 3748 - DNA, 69 bp, Artificial Sequence
  Synthetic construct
tgtgcgagttcgttaattcggccatattgtgatggtggtgcctgctactcgaattgggtcgacccctgg

SEQ ID NO: 3749 - DNA, 42 bp, Artificial Sequence
  Synthetic construct
tgtgcgaggtcgagagatggctacaactccctttatatctgg

SEQ ID NO: 3750 - DNA, 60 bp, Artificial Sequence
  Synthetic construct
tgtgcgagagagtcgaacgagcttcggagtgcttatcacccctatcactttgactactgg

SEQ ID NO: 3751 - DNA, 57 bp, Artificial Sequence
  Synthetic construct
tgtgcgagagattcccacctggttcggggagtcgagtctcccgaatctgactactgg

SEQ ID NO: 3752 - DNA, 45 bp, Artificial Sequence
  Synthetic construct
tgtgcgagacagatgggagattattactactatatggacgtctgg

SEQ ID NO: 3753 - DNA, 42 bp, Artificial Sequence
  Synthetic construct
tgtgcgagatcaatctggcaaccggaatactttgactactgg

SEQ ID NO: 3754 - DNA, 51 bp, Artificial Sequence
  Synthetic construct
tgtgcggggctgagttattatgacaattttggctctcaaaatgactactgg

SEQ ID NO: 3755 - DNA, 45 bp, Artificial Sequence
  Synthetic construct
tgttcgacatcaaagtactacgacaccttacacctctcttcctgg

SEQ ID NO: 3756 - DNA, 63 bp, Artificial Sequence
  Synthetic construct
tgtgcgagagttattactagggcgagtcctggcacagacgggaggtaccgtatggacgtctgg

SEQ ID NO: 3757 - DNA, 39 bp, Artificial Sequence
  Synthetic construct
tgtgcgagagagggtccggggcggggccttgactactgg

SEQ ID NO: 3758 - DNA, 42 bp, Artificial Sequence
  Synthetic construct
tgtgcgagagattccctccagtatagggcttttgatatctgg

SEQ ID NO: 3759 - DNA, 72 bp, Artificial Sequence
  Synthetic construct
tgtgcgagagggaatttagttcaatattttgactggtcccaagactactactactactacatggacgtctgg

SEQ ID NO: 3760 - DNA, 54 bp, Artificial Sequence
  Synthetic construct
tgtgcgagagacatgtacaggatctacttctactactactacatggacgtctgg

SEQ ID NO: 3761 - DNA, 57 bp, Artificial Sequence
  Synthetic construct
tgcgcgagaaatgttggcatttgcagtagtggcagctgccccccgtttgactcctgg

SEQ ID NO: 3762 - DNA, 66 bp, Artificial Sequence
  Synthetic construct
tgtgcgagagaggggacgtattactatgatagtagtggttattactacaactggttcgacccctgg

SEQ ID NO: 3763 - DNA, 48 bp, Artificial Sequence
  Synthetic construct
tgtgtgagggaacgtactatggatccgggagtcccctttgactactgg

SEQ ID NO: 3764 - DNA, 51 bp, Artificial Sequence
  Synthetic construct
tgtgcgagagaggtggataaagctctggtcggagagctttttgactcctgg

SEQ ID NO: 3765 - DNA, 51 bp, Artificial Sequence
  Synthetic construct
tgtgtgggactgtacttttatgacaacagcggcaccgaaaatgactgttgg

SEQ ID NO: 3766 - DNA, 51 bp, Artificial Sequence
  Synthetic construct
tgtatgcgacgcgtggtggtgattgatactagggattcttttgacatgtgg

SEQ ID NO: 3767 - DNA, 66 bp, Artificial Sequence
  Synthetic construct
tgtgcgagagccgaggcgtattacgataatttgcccggttattatgcaagtgcgtttgatatatgg

SEQ ID NO: 3768 - DNA, 69 bp, Artificial Sequence
  Synthetic construct
tgcgcggcaacgattttggctaattatgatgtcgtttttgggagtgatcgccgctcctttgacttctgg

SEQ ID NO: 3769 - DNA, 90 bp, Artificial Sequence
  Synthetic construct
tgtgcgcgcgtggcagcctatcacaatgcttcggggagtttccgtcctagtgggcgctcctactccttcttctactacatggacgtctgg

SEQ ID NO: 3770 - DNA, 51 bp, Artificial Sequence
  Synthetic construct
tgtgcgagaggccgggggccattgagggggggaagctggttcgactcctgg

SEQ ID NO: 3771 - DNA, 60 bp, Artificial Sequence
  Synthetic construct
tgtacgagaggccccagaaagtggctacaacaccaatctcgggggggctttgacatctgg

SEQ ID NO: 3772 - DNA, 54 bp, Artificial Sequence
  Synthetic construct
tgtgcgagaaagggaacttatagcagtggctggtacgatgcttttgatatctgg

SEQ ID NO: 3773 - DNA, 57 bp, Artificial Sequence
  Synthetic construct
tgtgcgagaggcgcccccaccgttcggggagttattaccaactggttcgacccctgg

SEQ ID NO: 3774 - DNA, 69 bp, Artificial Sequence
  Synthetic construct
tgtgcgagaggcgtaagatggatggttcggggcggccggtcttactactactactacatggacgtctgg

SEQ ID NO: 3775 - DNA, 63 bp, Artificial Sequence
  Synthetic construct
tgtgcgagaggctactatagggtgtggaattactatggttcgggcaactacacggacgtctgg

SEQ ID NO: 3776 - DNA, 60 bp, Artificial Sequence
  Synthetic construct
tgtgcgagaggctgggcccactatagggttcggggagctaagcgttattttgactactgg

SEQ ID NO: 3777 - DNA, 57 bp, Artificial Sequence
  Synthetic construct
tgtgcgagagggggccggattgtagtagtaccagctgctagctactttgactactgg

SEQ ID NO: 3778 - DNA, 48 bp, Artificial Sequence
  Synthetic construct
tgtgcgagattatcatttggttcgggggatgatgcttttgatatctgg

SEQ ID NO: 3779 - DNA, 63 bp, Artificial Sequence
  Synthetic construct
tgtacgagaggccttagagcagtggttggtacttcctacaactactactacatggacgtctgg

SEQ ID NO: 3780 - DNA, 84 bp, Artificial Sequence
  Synthetic construct
tgtgcgagagtccttggggaggcggaatccgattatttgactggttctcatcttcgttactactactactacatggacgtctgg

SEQ ID NO: 3781 - DNA, 48 bp, Artificial Sequence
  Synthetic construct
tgtgcgagaggccttgggaagcagtggttcagctgcttcgacccctgg

SEQ ID NO: 3782 - DNA, 39 bp, Artificial Sequence
  Synthetic construct
tgtgcgagagttactaacagaggctggtatagggcctgg

SEQ ID NO: 3783 - DNA, 72 bp, Artificial Sequence
  Synthetic construct
tgtgcgagagggggagcctattccgatttttggagtggctttccaaatgcccgagccttctttgactcctgg

SEQ ID NO: 3784 - DNA, 66 bp, Artificial Sequence
  Synthetic construct
tgttcgagaggaaatgccgggatagccggtcatatttttcacttcctctactacatcgacgtctgg

SEQ ID NO: 3785 - DNA, 45 bp, Artificial Sequence
  Synthetic construct
tgtgcgagagatggcccgggaaagaactacttcttggacgtctgg

SEQ ID NO: 3786 - DNA, 48 bp, Artificial Sequence
  Synthetic construct
tgtgccagagtctacaatggagatggcaacaaccccattgactactgg

SEQ ID NO: 3787 - DNA, 66 bp, Artificial Sequence
  Synthetic construct
tgtgccagagggtccctggatgatgatagtagtggttattactcctactactatatggacgtctgg

SEQ ID NO: 3788 - DNA, 51 bp, Artificial Sequence
  Synthetic construct
tgtgccagagccaagggagatggctacattgggggcatttttgactcctgg

SEQ ID NO: 3789 - DNA, 57 bp, Artificial Sequence
  Synthetic construct
tgtgcgagactgaattactatgatcgtaatggtcattactattactttgactactgg

SEQ ID NO: 3790 - DNA, 51 bp, Artificial Sequence
  Synthetic construct
tgtgcgagaaacttcggtgactacgcctacccctacttctttgacttctgg

SEQ ID NO: 3791 - DNA, 54 bp, Artificial Sequence
  Synthetic construct
tgtgcgagaggtattattttgagtgggtcccccctctactacctggacgtctgg

SEQ ID NO: 3792 - DNA, 42 bp, Artificial Sequence
  Synthetic construct
tgtgcgagattcgcccgactagactactacatggacgtctgg

SEQ ID NO: 3793 - DNA, 69 bp, Artificial Sequence
  Synthetic construct
tgtgcccgactttactggggttgtactaatggtgtatgctcctactactactactacatggacgtctgg

SEQ ID NO: 3794 - DNA, 63 bp, Artificial Sequence
  Synthetic construct
tgtgcgagaatcccgaccccgaatgtgggatatacagctgggtactactacatggacgtctgg

SEQ ID NO: 3795 - DNA, 45 bp, Artificial Sequence
  Synthetic construct
tgtgcgagagaaaggcatgactacgtaggagcttttgatatctgg

SEQ ID NO: 3796 - DNA, 60 bp, Artificial Sequence
  Synthetic construct
tgtgcgagagaaggaagcagcagctggtacacgacctggggatgggcttttgatatctgg

SEQ ID NO: 3797 - DNA, 45 bp, Artificial Sequence
  Synthetic construct
tgtgcgagagataatcagattactaaggatgcttttgatatctgg

SEQ ID NO: 3798 - DNA, 57 bp, Artificial Sequence
  Synthetic construct
tgtgcgagagatcggagctatagtggctactactactactactacatggacgtctgg

SEQ ID NO: 3799 - DNA, 36 bp, Artificial Sequence
  Synthetic construct
tgtgcgagcggtattggtgactactttgactactgg

SEQ ID NO: 3800 - DNA, 60 bp, Artificial Sequence
  Synthetic construct
tgtgcgagacgacattcggagcagtggctgttaaggggccctggtgcttttgatatctgg

SEQ ID NO: 3801 - DNA, 48 bp, Artificial Sequence
  Synthetic construct
tgtgcgagagggtcggaatggcgtctctattactactttgactactgg

SEQ ID NO: 3802 - DNA, 51 bp, Artificial Sequence
  Synthetic construct
tgtgcgagacgggtggtggtagatcctactctcgggtcatttgatatctgg

SEQ ID NO: 3803 - DNA, 36 bp, Artificial Sequence
  Synthetic construct
tgtgcgagagatcgcaggggatacagcttttactgg

SEQ ID NO: 3804 - DNA, 63 bp, Artificial Sequence
  Synthetic construct
tgtgcgagagagttttattactctgatagtaatgattttccatttcatgtttttgatatctgg

SEQ ID NO: 3805 - DNA, 39 bp, Artificial Sequence
  Synthetic construct
tgtgcgagagagggtataggcggagctactgatatctgg

SEQ ID NO: 3806 - DNA, 57 bp, Artificial Sequence
  Synthetic construct
tgtgcgagagatctcggctacggtggtaactccccccactggtacttcgatctctgg

SEQ ID NO: 3807 - DNA, 48 bp, Artificial Sequence
  Synthetic construct
tgtgcgagagcggactacggtgactacgaggactactttgactactgg

SEQ ID NO: 3808 - DNA, 39 bp, Artificial Sequence
  Synthetic construct
tgtgcgagaggcggcggaggggggtggttcgacccctgg

SEQ ID NO: 3809 - DNA, 54 bp, Artificial Sequence
  Synthetic construct
tgtgcgagagggggactctatggttcggggagagtaaactggttcgacccctgg

SEQ ID NO: 3810 - DNA, 42 bp, Artificial Sequence
  Synthetic construct
tgtgcgagatcccgttcgaggcagcagccaaatgactactgg

SEQ ID NO: 3811 - DNA, 48 bp, Artificial Sequence
  Synthetic construct
tgtgcgagagatcgtaagggtagtgacggtgatagcatggacgtctgg

SEQ ID NO: 3812 - DNA, 63 bp, Artificial Sequence
  Synthetic construct
tgtgcgagggcccgacaccgatactacgattctttgactggccaggggtcctttgattactgg

SEQ ID NO: 3813 - DNA, 42 bp, Artificial Sequence
  Synthetic construct
tgtgtgagagggggagatatagagactaccatggagttctgg

SEQ ID NO: 3814 - DNA, 54 bp, Artificial Sequence
  Synthetic construct
tgtgcgcgaaatgggcctaagtggaacaattactactactacatggacgtctgg

SEQ ID NO: 3815 - DNA, 48 bp, Artificial Sequence
  Synthetic construct
tgtgtgaggacccttagagatggcttcaattcctggttcgacccctgg

SEQ ID NO: 3816 - DNA, 51 bp, Artificial Sequence
  Synthetic construct
tgtgcgagaggcccacccatagacgactactactactacatggacgtctgg

SEQ ID NO: 3817 - DNA, 69 bp, Artificial Sequence
  Synthetic construct
tgtactagacatctgatgaattttgatttctggagtggctattatacggtgaacgcttttgatatctgg

SEQ ID NO: 3818 - DNA, 51 bp, Artificial Sequence
  Synthetic construct
tgtgcgagaaggacatatgctgttaacggtgattactactttgactcctgg

SEQ ID NO: 3819 - DNA, 69 bp, Artificial Sequence
  Synthetic construct
tgtgcgcgaggccttttttattttgggtcggggacttatgcacgagatccacggagttgggggtactgg

SEQ ID NO: 3820 - DNA, 66 bp, Artificial Sequence
  Synthetic construct
tgtgcgagaggggaggcgatagtattgtttggggagctgttaaaacgcccttatatggatgtctgg

SEQ ID NO: 3821 - DNA, 54 bp, Artificial Sequence
  Synthetic construct
tgtgcgagaggctcagcacgtctagcagcaggaagaagtgcttttgatttctgg

SEQ ID NO: 3822 - DNA, 57 bp, Artificial Sequence
  Synthetic construct
tgtgcgaggacccccccatatagtggctacgattacgaaggctactttgactactgg

SEQ ID NO: 3823 - DNA, 51 bp, Artificial Sequence
  Synthetic construct
tgtgcgagaggggactggtttcagggtagtggccttccttttgactcctgg

SEQ ID NO: 3824 - DNA, 42 bp, Artificial Sequence
  Synthetic construct
tgtgccagggctgggaggggcccaagtgtctttgactactgg

SEQ ID NO: 3825 - DNA, 51 bp, Artificial Sequence
  Synthetic construct
tgtgcgacgtatgattcggggagttattaccaatctcccttagacttctgg

SEQ ID NO: 3826 - DNA, 48 bp, Artificial Sequence
  Synthetic construct
tgtgcgagacattcagattggatacagttgtggttctttgacttctgg

SEQ ID NO: 3827 - DNA, 90 bp, Artificial Sequence
  Synthetic construct
tgtgcgcgagtggcagcgtatcacaatgcttcggggagtttccgtcctagtgggcgctcctactccttcttctactacatggacgtctgg

SEQ ID NO: 3828 - DNA, 48 bp, Artificial Sequence
  Synthetic construct
tgtgcgagaatgggggcatatggcagtggcttttatgggggatactgg

SEQ ID NO: 3829 - DNA, 24 bp, Artificial Sequence
  Synthetic construct
tgtacgagaagtgatagacactgg

SEQ ID NO: 3830 - DNA, 60 bp, Artificial Sequence
  Synthetic construct
tgtgcgagacacggaggaagtacaccccactatattcgagtgaactggttcggcccctgg

SEQ ID NO: 3831 - DNA, 48 bp, Artificial Sequence
  Synthetic construct
tgtgcgagacaaacttcgcttgggggagttatcgcttttgacatctgg

SEQ ID NO: 3832 - DNA, 75 bp, Artificial Sequence
  Synthetic construct
tgtgcgacccatcctcgtgggacatttgagggagcccatgactattactactactactactacatggacgtctgg

SEQ ID NO: 3833 - DNA, 45 bp, Artificial Sequence
  Synthetic construct
tgtgcgagacacccctacggtggtaactccgggcaggactactgg

SEQ ID NO: 3834 - DNA, 60 bp, Artificial Sequence
  Synthetic construct
tgtgcgagatcaattcctttggaatatagtagtcaaacggggggtttgttcgacccctgg

SEQ ID NO: 3835 - DNA, 69 bp, Artificial Sequence
  Synthetic construct
tgtgcgagacggccgcccggcgattgtactaatggtgtatgctccacgcaaaggtggttcgacccctgg

SEQ ID NO: 3836 - DNA, 54 bp, Artificial Sequence
  Synthetic construct
tgtgcgagagctagcagctcgtccaaatactactactactacatggacgtctgg

SEQ ID NO: 3837 - DNA, 48 bp, Artificial Sequence
  Synthetic construct
tgtgcgagacggggagtgggagctacgaggaaggcttttgatatctgg

SEQ ID NO: 3838 - DNA, 57 bp, Artificial Sequence
  Synthetic construct
tgtgtgagacacgactacagtagcttttactactactactacttcatggacgtctgg

SEQ ID NO: 3839 - DNA, 36 bp, Artificial Sequence
  Synthetic construct
tgtgcgagcgcattagcagctggtaaatactactgg

SEQ ID NO: 3840 - DNA, 45 bp, Artificial Sequence
  Synthetic construct
tgtgcgagactcttaagcctgaggaatgcggcttttgatatctgg

SEQ ID NO: 3841 - DNA, 54 bp, Artificial Sequence
  Synthetic construct
tgtgcgagagattatattgatgtaacccacggctacagttgtttcgacccctgg

SEQ ID NO: 3842 - DNA, 63 bp, Artificial Sequence
  Synthetic construct
tgtgcgagagactttgatcaaggatattattcttcggggagttattcctggttcgacgcctgg

SEQ ID NO: 3843 - DNA, 51 bp, Artificial Sequence
  Synthetic construct
tgtgtgagagggggccgggcaactttgaccaacgcggactttgactactgg

SEQ ID NO: 3844 - DNA, 51 bp, Artificial Sequence
  Synthetic construct
tgtgcgagaacatatagtagtggttattatagtgatgcttttgatatctgg

SEQ ID NO: 3845 - DNA, 51 bp, Artificial Sequence
  Synthetic construct
tgtgtgagaaccccagcgttaggggagttagttggatacttccagccctgg

SEQ ID NO: 3846 - DNA, 63 bp, Artificial Sequence
  Synthetic construct
tgtgcgagagacgcatataattactatgcttcgaggagccgatacggttactttgactactgg

SEQ ID NO: 3847 - DNA, 63 bp, Artificial Sequence
  Synthetic construct
tgtgcgcgagacgggacgccggctgagcgacggtcctactcctactcctacatggacgtctgg

SEQ ID NO: 3848 - DNA, 42 bp, Artificial Sequence
  Synthetic construct
tgtgcgagaggggagtatctcggctactacatggacgtctgg

SEQ ID NO: 3849 - DNA, 69 bp, Artificial Sequence
  Synthetic construct
tgtgcgagaatgccgaatcttatggatacagctatggtttcctactactactactacatggacgtctgg

SEQ ID NO: 3850 - DNA, 48 bp, Artificial Sequence
  Synthetic construct
tgtgcgagaggggatgatagtagtggttatgccccctttgactactgg

SEQ ID NO: 3851 - DNA, 45 bp, Artificial Sequence
  Synthetic construct
tgtgcgagagtcaatactatggttcggggaacttttgactactgg

SEQ ID NO: 3852 - DNA, 66 bp, Artificial Sequence
  Synthetic construct
tgtgcgtcaacgtattactatgatagtagtgggggaagacgggttcctgttgcttttgaaatctgg

SEQ ID NO: 3853 - DNA, 57 bp, Artificial Sequence
  Synthetic construct
tgtgcgtcgaggggttcggggagttattataaagggggttactactttgactactgg

SEQ ID NO: 3854 - DNA, 63 bp, Artificial Sequence
  Synthetic construct
tgtgcgagagcgatggattactctgatagtagtggtgattattactattacttcgatctctgg

SEQ ID NO: 3855 - DNA, 54 bp, Artificial Sequence
  Synthetic construct
tgtgtgagagagagctcttatggttcggggactagcaaatacttcgacccctgg

SEQ ID NO: 3856 - DNA, 45 bp, Artificial Sequence
  Synthetic construct
tgtgtgagacgctggtacggtgactaccccgcctttgactactgg

SEQ ID NO: 3857 - DNA, 54 bp, Artificial Sequence
  Synthetic construct
tgtgcgagagtcttgtgtagtggtcgtaagtgccaaggggatttcgactactgg

SEQ ID NO: 3858 - DNA, 60 bp, Artificial Sequence
  Synthetic construct
tgtgcgagacttatggagtcttctgaccccgctaattacttctcctacatggacgtctgg

SEQ ID NO: 3859 - DNA, 57 bp, Artificial Sequence
  Synthetic construct
tgtgcgaccctgagttcttattatgatattttgactggtttggcctcggacgtctgg

SEQ ID NO: 3860 - DNA, 48 bp, Artificial Sequence
  Synthetic construct
tgtgcggggagacgctcggggaggggtgattactactttgaattgtgg

SEQ ID NO: 3861 - DNA, 48 bp, Artificial Sequence
  Synthetic construct
tgtgcgagagaaggttactatgatggtagtggttattacactcactgg

SEQ ID NO: 3862 - DNA, 39 bp, Artificial Sequence
  Synthetic construct
tgtgcgagagtgggcattgcagcaggtgtcgacgtctgg

SEQ ID NO: 3863 - DNA, 72 bp, Artificial Sequence
  Synthetic construct
tgcgcgagagagagggcggattacgatctttttactggttatccctcacgcccagatgcttttgaaatctgg

SEQ ID NO: 3864 - DNA, 60 bp, Artificial Sequence
  Synthetic construct
tgtgcgagacgcctggggtgggaacagggcggccgtcactcctactacatggacgtctgg

SEQ ID NO: 3865 - DNA, 54 bp, Artificial Sequence
  Synthetic construct
tgtgccagagatgggggctacgatgcagtcttattctactacctgggcgtctgg

SEQ ID NO: 3866 - DNA, 42 bp, Artificial Sequence
  Synthetic construct
tgtgggaggatccatgatagtggttggttcgttctttattgg

SEQ ID NO: 3867 - DNA, 51 bp, Artificial Sequence
  Synthetic construct
tgtgcgaggcacccgcggaagttcggggagttattgggatttgactcctgg

SEQ ID NO: 3868 - DNA, 54 bp, Artificial Sequence
  Synthetic construct
tgtgcggcggagggaggtgattgtcttaatggtgtgtgctataaagtctcctgg

SEQ ID NO: 3869 - DNA, 39 bp, Artificial Sequence
  Synthetic construct
tgtgcgagaggtctgtcctcagtggctggcacggggtgg

SEQ ID NO: 3870 - DNA, 51 bp, Artificial Sequence
  Synthetic construct
tgtgcatcagcagagcagtggcccacggagcacgacgcttttgatatctgg

SEQ ID NO: 3871 - DNA, 66 bp, Artificial Sequence; identical to SEQ ID NO: 1774
  Synthetic construct

SEQ ID NO: 3872 - DNA, 57 bp, Artificial Sequence
  Synthetic construct
tgtgcgagaggaggcggtgggttcagtcatggccgcctcaaggctcttgatgtctgg

SEQ ID NO: 3873 - DNA, 54 bp, Artificial Sequence
  Synthetic construct
tgcgcgagagtcggcctgttgcagcaggtggcccatgatgctttggatatctgg

SEQ ID NO: 3874 - DNA, 51 bp, Artificial Sequence
  Synthetic construct
tgtgcgagaccttgtagtggtgctaactgcttcaacacggcgggtctctgg

SEQ ID NO: 3875 - DNA, 57 bp, Artificial Sequence
  Synthetic construct
tgtacgagaggccggctgattttcagcagcagccggtacgatgcttttgatatctgg

SEQ ID NO: 3876 - DNA, 51 bp, Artificial Sequence
  Synthetic construct
tgtgcgagagatatggggcgtattggaagtagcaccgaatttgactgctgg

SEQ ID NO: 3877 - DNA, 45 bp, Artificial Sequence
  Synthetic construct
tgtgcaacagatcggcgagtggaaactctctactttcacttctgg

SEQ ID NO: 3878 - DNA, 51 bp, Artificial Sequence
  Synthetic construct
tgtgtacgcgactatgattacgttgggggcagttatcgtcttgaccggtgg

SEQ ID NO: 3879 - DNA, 51 bp, Artificial Sequence
  Synthetic construct
tgtgcgagacttctcaaggggtccagttggtacaatggtcttgacatctgg

SEQ ID NO: 3880 - DNA, 48 bp, Artificial Sequence
  Synthetic construct
tgtgcgaaacggtataatactacccacctttggtactttgactcctgg

SEQ ID NO: 3881 - DNA, 75 bp, Artificial Sequence
  Synthetic construct
caggtgcagctggtacagtctggagctgaggtgaagaagcctggggcctcagtgaaggtctcttgtaaggcttcc

SEQ ID NO: 3882 - DNA, 22 bp, Artificial Sequence
  Synthetic construct
tgtatgggcatgcaaggcctct

SEQ ID NO: 3883 - DNA, 75 bp, Artificial Sequence
  Synthetic construct
caggtccagctggtgcagtctggggctgaggtgaagaagcctgggtcctcggtgaaggtctcctgcgagacctct

SEQ ID NO: 3884 - DNA, 75 bp, Artificial Sequence
  Synthetic construct
gaggtgcagctggtggagtctgggggaggcttggtccagcctggggggtccctgaaactctcctgtgcagcctct

SEQ ID NO: 3885 - DNA, 75 bp, Artificial Sequence
  Synthetic construct
caggtgcacctggtggagtctgggggaggcgtggtccagcctgggaggtccctgagactctcctgtgcggcctct

SEQ ID NO: 3886 - DNA, 75 bp, Artificial Sequence
  Synthetic construct
caggtgcacctggtggagtccgggggaggcgtggtccagcctgggaggtccctgagactctcgtgtgtaggctct

SEQ ID NO: 3887 - DNA, 75 bp, Artificial Sequence
  Synthetic construct
gaggtgcagttggtggagtctgggggaggcttggtccagccgggggggtccctaagactctcctgtgcagcctca

SEQ ID NO: 3888 - DNA, 75 bp, Artificial Sequence
  Synthetic construct
gagatgcagctggtggagtccgggggaggcttggtccagccgggggggtccctgagactctcctgtgcagcctct

SEQ ID NO: 3889 - DNA, 75 bp, Artificial Sequence
  Synthetic construct
gaggtgcggctggtggagtctggggggggcttggtccagcctggggggtccctgaaactctcctgtgaagcgtct

SEQ ID NO: 3890 - DNA, 75 bp, Artificial Sequence
  Synthetic construct
gaggtccagttggtacagtccggggctgaggtgaagaagcctggggccaccgtgaaaatctcctgcaaggcttct

SEQ ID NO: 3891 - DNA, 75 bp, Artificial Sequence
  Synthetic construct
caggtgcagttggtgcagtctggggctgaggtgaagaagcctggggcctcagtgaagatttcctgcaagtcatct

SEQ ID NO: 3892 - DNA, 75 bp, Artificial Sequence
  Synthetic construct
caggtgcagctggtgcagtctggggctgaggtgaagaagcctggggcctcagtgaaggtctcctgtaaggcttct

SEQ ID NO: 3893 - DNA, 75 bp, Artificial Sequence
  Synthetic construct
caagtgcaactggtgcagtctggggctgaggtgaagaagcctggggcctcagtgaaggtctcctgcaaggcttct

SEQ ID NO: 3894 - DNA, 75 bp, Artificial Sequence
  Synthetic construct
caggtacagctggtgcagtctgggtctgagttgaagaagcctggggcctcagtgacggtttcctgcaaggcttct

SEQ ID NO: 3895 - DNA, 75 bp, Artificial Sequence
  Synthetic construct
caggtgcagctggtgcagtctggggctgaggtgaaggagcctggggcctcagtgaaggtctcctgcaaggcttct

SEQ ID NO: 3896 - DNA, 75 bp, Artificial Sequence
  Synthetic construct
caggtgcaactggtgcagtctggggctgaggtgaaggagcctggggcctcagtgaaaatttcctgcaaggcatct

SEQ ID NO: 3897 - DNA, 75 bp, Artificial Sequence
  Synthetic construct
caggtccaccttctgcagtctggggctgaggtgaagaagcctggggcctcagtgaaggtttcctgcgaggcttct

SEQ ID NO: 3898 - DNA, 75 bp, Artificial Sequence
  Synthetic construct
caggaacttttgatacagtctggggctgaggtgaagaagcctggggcctcagtgagggtctcctgcgcggcttct

SEQ ID NO: 3899 - DNA, 75 bp, Artificial Sequence
  Synthetic construct
caggtccagcttgtgcagtctggggctgaggtgaagaagcctggggcctcagtgaaggtttcctgcaaggcttct

SEQ ID NO: 3900 - DNA, 75 bp, Artificial Sequence
  Synthetic construct
caggtccaacttgtgcagtctggggctgaggtggagaagcctggggcctcggtgaaggtttcctgcaaggcttct

SEQ ID NO: 3901 - DNA, 75 bp, Artificial Sequence
  Synthetic construct
caggtccagcttgtgcagtctggggctgaggtgaagaagcctggggcctcagtgaaggtttcctgcaaggcctct

SEQ ID NO: 3902 - DNA, 75 bp, Artificial Sequence
  Synthetic construct
caggtgcagctggtgcagtctgtggctgaggtgaagaagcctggggcctcagtgaaggtctcctgcaaggcttct

SEQ ID NO: 3903 - DNA, 75 bp, Artificial Sequence
  Synthetic construct
gaggtccagctgatacaatccggggctgaggtgaagaagcctgggacgaccgtgaaagtctcctgcaagacgtct

SEQ ID NO: 3904 - DNA, 75 bp, Artificial Sequence
  Synthetic construct
gaggtccggctggcacagtccggggctgaggtgaagaagcctggggccaccatgaaaatctcctgcaaggcttct

SEQ ID NO: 3905 - DNA, 75 bp, Artificial Sequence
  Synthetic construct
caggtgcagctggtgcagtctggggctgaggtgaagaagcctggggcctctgtgaaggtctcctgcaaggcttct

SEQ ID NO: 3906 - DNA, 75 bp, Artificial Sequence
  Synthetic construct
caggtgcagctggtgcaatctggggctgaggtgaagaagcctggggcctcagtgaaggtctcctgcaaggcttct

SEQ ID NO: 3907 - DNA, 75 bp, Artificial Sequence
  Synthetic construct
caggtgcagctggtgcagtctggggctgaggtgaagaagcctggggcctcagtgaaggtctcctgcaaggcttct

SEQ ID NO: 3908 - DNA, 75 bp, Artificial Sequence
  Synthetic construct
caggtgcagctggtgcagtctggggctgaggtgaagaacactggggcctcagtgaaggtctcctgcaaggcttct

SEQ ID NO: 3909 - DNA, 75 bp, Artificial Sequence
  Synthetic construct
caggtgcagctggtgcagtctggggctgaggtgaagaagcctggggcctcagtgagggtctcctgcgaggcttct

SEQ ID NO: 3910 - DNA, 75 bp, Artificial Sequence
  Synthetic construct
caggtgcagctggtgcagtctggggctgaggtgaagaagcctggggcctcagtgaaggtctcctgcgaggcttct

SEQ ID NO: 3911 - DNA, 75 bp, Artificial Sequence
  Synthetic construct
caggtccagctggtgcagtctggggctgaggtgaagaagcctgggtcctcggtgaaggtctcctgcaaggcttct

SEQ ID NO: 3912 - DNA, 75 bp, Artificial Sequence
  Synthetic construct
caggtccagttggtgcagtctggggctgaggtgaagaagcctgggtcctcggtgaaggtctcctgccaggcttct

SEQ ID NO: 3913 - DNA, 75 bp, Artificial Sequence
  Synthetic construct
caggttcagctggtgcagtctggagctgaggtgaagaagcctggggcctcagtgaaggtctcctgcaaggcttct

SEQ ID NO: 3914 - DNA, 75 bp, Artificial Sequence; identical to SEQ ID NO: 1778
  Synthetic construct

SEQ ID NO: 3915 - DNA, 75 bp, Artificial Sequence
  Synthetic construct
caggtgcagctggagcaatctgggtctgagtttaagaagcctggggcctcagtgaagatttcctgcaaggcttct

SEQ ID NO: 3916 - DNA, 75 bp, Artificial Sequence
  Synthetic construct
caggtccagttggtgcagtctggggctgaggtgaagaagcctgggtcctcggtgaaggtctcctgcaaggcttct

SEQ ID NO: 3917 - DNA, 75 bp, Artificial Sequence
  Synthetic construct
caggtccagctggtgcagtctggggctgaggtgaaggagcctgggtcctcggtgaaggtctcctgcaaggcttct

SEQ ID NO: 3918 - DNA, 75 bp, Artificial Sequence
  Synthetic construct
caggttcacctggtgcagtctggcgctgaagtgaagaagcctggggcctcagtgaaagtctcctgcaagacttct

SEQ ID NO: 3919 - DNA, 75 bp, Artificial Sequence
  Synthetic construct
caggtccagctggtgcaatctggggctgaggtgaagaagcctgggtcctcggttaaggtctcctgcaaggcttct

SEQ ID NO: 3920 - DNA, 75 bp, Artificial Sequence
  Synthetic construct
caggttcagctggtgcagtctggagctgaggtgaacaagcctggggcctcagtgaaggtctcctgtagggctttt

SEQ ID NO: 3921 - DNA, 75 bp, Artificial Sequence
  Synthetic construct
caggttcagctggtgcaatctggaggtgaggtgaagaagcctggggcctcagtgaaggtctcctgcaaggcttct

SEQ ID NO: 3922 - DNA, 75 bp, Artificial Sequence
  Synthetic construct
caggtccaactggtgcagtctggggctgaggtgaagaagccggggtcctcggtgaaggtctcctgcaaggctcct

SEQ ID NO: 3923 - DNA, 75 bp, Artificial Sequence
  Synthetic construct
caggtgcagctggtgcagtcaggagccgaggtgaagaaaccaggcagctccgtgaaggtcagctgcaaagcttcc

SEQ ID NO: 3924 - DNA, 75 bp, Artificial Sequence
  Synthetic construct
caggtccacctggtgcagtctggggctgaagtgaagaagcctgggtcgtcggtaaaggtctcttgcaaggcttct

SEQ ID NO: 3925 - DNA, 75 bp, Artificial Sequence
  Synthetic construct
caggttcaacttgtgcagtctggagctgaggtgaagaagcctggggcctcagtgaaggtctcctgtaaggcttct

SEQ ID NO: 3926 - DNA, 75 bp, Artificial Sequence
  Synthetic construct
caggtccaactggtgcagtctggggctgaggtgaagaagcctgggtcctcggtgaaggtctcctgcaaggcttct

SEQ ID NO: 3927 - DNA, 75 bp, Artificial Sequence
  Synthetic construct
caggtccagttggtgcagtctggggctgaggtgaagaagactgggtcctcggtgaaggtctcctgcaaggcctct

SEQ ID NO: 3928 - DNA, 75 bp, Artificial Sequence
  Synthetic construct
caggtccagctggtgcagtcaggggctgaggtgaagaagcctgggtcctcggtgaaggtctcctgcaaggcttct

SEQ ID NO: 3929 - DNA, 75 bp, Artificial Sequence
  Synthetic construct
caggtccagctggtgcagtctggggctgaggtgaagaagcctgggtcctcggtgaaggtctcctgcacggcttct

SEQ ID NO: 3930 - DNA, 75 bp, Artificial Sequence
  Synthetic construct
cagattcagctggtgcagtctggaggtgaggtgaagaagcctggggcctcagtgaaggtctcctgcaaggcttct

SEQ ID NO: 3931 - DNA, 75 bp, Artificial Sequence
  Synthetic construct
caggttaagatggtgcagtctggagctgaggtgaagaagcctggggcctcagtgaaggtctcctgcaaggcttct

SEQ ID NO: 3932 - DNA, 75 bp, Artificial Sequence
  Synthetic construct
caggttcagctggtgcagtctggagctgaggtgaagaagcctggggcctcagtgaaggtctcctgcaaggcctct

SEQ ID NO: 3933 - DNA, 75 bp, Artificial Sequence
  Synthetic construct
caggttcagctggtgcagtctggaggtgaggtgaagaagcctggggcctcagtgagggtctcctgcaaggcttct

SEQ ID NO: 3934 - DNA, 75 bp, Artificial Sequence
  Synthetic construct
caggtccagctggtacaatctggggctgaggtgaagaagccggggtcctcggtgaaggtctcctgcacggcttct

SEQ ID NO: 3935 - DNA, 75 bp, Artificial Sequence
  Synthetic construct
caggtccaactggtacaatctggggctgaggtgaagaagcctgggtcctcggtgaaagtctcctgcaaggcttcc

SEQ ID NO: 3936 - DNA, 75 bp, Artificial Sequence
  Synthetic construct
caggttcagctggtgcagtccggagctgaggtgaagaagcctggggcctcagtgagggtctcctgcacggcctct

SEQ ID NO: 3937 - DNA, 75 bp, Artificial Sequence
  Synthetic construct
caggtccagttggtgcagtctggggctgaggtgatgcagcctgggtccgcggtgaaggtctcctgcgaggcttct

SEQ ID NO: 3938 - DNA, 75 bp, Artificial Sequence
  Synthetic construct
caggtccagctggtgcagtctggggctgaaatgaagaagcctgggtcctcggtgaaggtctcctgcaaggcctct

SEQ ID NO: 3939 - DNA, 75 bp, Artificial Sequence
  Synthetic construct
caggttcagttggtgcagtctggaggcgaggtgaggaagcctggggcctcactgaaggtctcctgccaggcttct

SEQ ID NO: 3940 - DNA, 75 bp, Artificial Sequence
  Synthetic construct
caggtgcagctggtgcagtctggggctgaggtgaagaagcctgggtcctcggtgaaggtctcctgcaaggcttct

SEQ ID NO: 3941 - DNA, 75 bp, Artificial Sequence
  Synthetic construct
caagttgagatggtacagtcaggagctgaggtgaagaagcctggggcctcagtgaaggtctcctgcaaggcttct

SEQ ID NO: 3942 - DNA, 75 bp, Artificial Sequence
  Synthetic construct
caggtccagctggtgcagtctggggctgaggtgaagaggcctgggtcctcggtgacgatctcctgcaagacttct

SEQ ID NO: 3943 - DNA, 75 bp, Artificial Sequence
  Synthetic construct
caggtgcagttgctgcaatctgggtctgaggtggagaggcctggggcctcagtgaaggttgcctgcaaggcttcc

SEQ ID NO: 3944 - DNA, 75 bp, Artificial Sequence
  Synthetic construct
gaggtccaactggtacagtccggggctgaggtgaagaagcctggggccaccgtgaaaatctcctgcaatgcttct

SEQ ID NO: 3945 - DNA, 75 bp, Artificial Sequence
  Synthetic construct
cagctgcagttggtggagtctgggggaggcgtggtccagcctgggaagtcgctgaggctctcctgtgcaggctct

SEQ ID NO: 3946 - DNA, 75 bp, Artificial Sequence
  Synthetic construct
gaggtccagctggtacagtccggggctgaggtgaagaagcctggggccaccgtgaaaatctcctgtaaggcttct

SEQ ID NO: 3947 - DNA, 75 bp, Artificial Sequence
  Synthetic construct
caggtccagctggtgcagtctggggctgaggtgaagaagcctgggtcctcggtgaaggtctcctgcaaggctcct

SEQ ID NO: 3948 - DNA, 75 bp, Artificial Sequence
  Synthetic construct
caggtgcagctggtgcagtctggggctgaggtgaagaagcctggggcctcagtgaaggtttcctgcaaggcatct

SEQ ID NO: 3949 - DNA, 75 bp, Artificial Sequence
  Synthetic construct
caggtgcagctggtgcagtctgggactgaggtgaagaagactggggcctcagtgaaaatctcctgcaaggcctct

SEQ ID NO: 3950 - DNA, 75 bp, Artificial Sequence
  Synthetic construct
caggtgcagctggtgcaatctggggctgaggtgaagaagcctggggcctcagtgaaggtctcctgtaaggcttct

SEQ ID NO: 3951 - DNA, 75 bp, Artificial Sequence
  Synthetic construct
caggtccttctggtacaatctggggctgaggtgaagaagcctggggcctcagtgaaggtctcctgcaaggtttcc

SEQ ID NO: 3952 - DNA, 75 bp, Artificial Sequence
  Synthetic construct
caggtccaattggtacagcctggggctgaggtgaagaagcctggggcctcagtgaaggtctcctgcaaagtttcc

SEQ ID NO: 3953 - DNA, 75 bp, Artificial Sequence
  Synthetic construct
caggtgcagctggtgcagtctggggctgaggtgaagaagcctggggcctcagtgaaggtctcctgtacggcctct

SEQ ID NO: 3954 - DNA, 75 bp, Artificial Sequence
  Synthetic construct
caggtgcacctggtgcagtctggggctgagttgaagaagcctggggcctcgctgaggatttcctgcaaggcaagt

SEQ ID NO: 3955 - DNA, 75 bp, Artificial Sequence
  Synthetic construct
cagtcccttctgacgcagtctggggccgagttgaagaagcctgggtcctctgtgagggtctcctgtcaggcttct

SEQ ID NO: 3956 - DNA, 75 bp, Artificial Sequence
  Synthetic construct
caggtccaacttgtgcagtctgcggctgacgtgaagaagcctggggcctcagtgaaggtttcctgcaaggcttct

SEQ ID NO: 3957 - DNA, 75 bp, Artificial Sequence
  Synthetic construct
gaggtgcagctggtgcagtctggagcagaggtgaaaaagccgggggagtctctgaagatctcctgtaagggttct

SEQ ID NO: 3958 - DNA, 75 bp, Artificial Sequence
  Synthetic construct
gaggtgcagctggtgcagtctggagcagaggtgaaaaagccgggggagtctctgaagatctcctgtcagggttct

SEQ ID NO: 3959 - DNA, 75 bp, Artificial Sequence
  Synthetic construct
gaggtgcagctggtgcagtctggagcagaggtgaaaaagcccggacagtctctgacaatctcctgtaaggcttct

SEQ ID NO: 3960 - DNA, 75 bp, Artificial Sequence
  Synthetic construct
gaggtgcagctggtgcagtctggagcagaggtgagaaagccgggggagtttctggagatctcctgtaaggattct

SEQ ID NO: 3961 - DNA, 75 bp, Artificial Sequence
  Synthetic construct
gaggtgcgactggtgcagtctggagcagaggtgaaaaagccgggggaatctctgaagatctcctgtaagggctct

SEQ ID NO: 3962 - DNA, 75 bp, Artificial Sequence
  Synthetic construct
gaggcgcagctggtgcagtctggagcagaggtgaaaaagccgggggagtctctgaggatctcctgtaaggcttct

SEQ ID NO: 3963 - DNA, 75 bp, Artificial Sequence
  Synthetic construct
gaggtgcagctggtgcagtctggagcagaggtgaaaaagccgggggagtctctgaagatctcctgtaaggcttct

SEQ ID NO: 3964 - DNA, 75 bp, Artificial Sequence
  Synthetic construct
gaggtgcagctggtgcagtctggagcagaggtgaaaaagccgggggagtctctgaagatctcctgtcaggtttct

SEQ ID NO: 3965 - DNA, 75 bp, Artificial Sequence
  Synthetic construct
ggggtgcacctggagcagtctggagcagaggtgaaaaagccgggggagtctctgaagatctcctgtaagggttct

SEQ ID NO: 3966 - DNA, 75 bp, Artificial Sequence
  Synthetic construct
gaagttcaactggaacagtctggagcggaggtgaagaagccgggggagtctctgaagatcgcctgcaagtgttct

SEQ ID NO: 3967 - DNA, 75 bp, Artificial Sequence
  Synthetic construct
gaggtgcagctggtgcagtctggagcagaggtgaaaaagtcgggggagtctctgaagatctcctgtaagggttct

SEQ ID NO: 3968 - DNA, 75 bp, Artificial Sequence
  Synthetic construct
gaggtgcagctggtgcagtctggagcagaggtcaaaaagccgggggagtctctgaagatctcctgtaagggttct

SEQ ID NO: 3969 - DNA, 75 bp, Artificial Sequence
  Synthetic construct
gaggagcagctggtgcagtctggagcagaggcgagaaagccgggggagtctctgaagatctcctgtaagggttct

SEQ ID NO: 3970 - DNA, 75 bp, Artificial Sequence
  Synthetic construct
gaggtgcacctggtgcagtctggagcagaggtgaaaaagccgggggagtctctaaagatctcctgtcagggttct

SEQ ID NO: 3971 - DNA, 75 bp, Artificial Sequence
  Synthetic construct
gaggtgcagctggtgcagtctgaagcagaggtgaaaaagccgggggagtctctgaagatctcctgtaaggcttct

SEQ ID NO: 3972 - DNA, 75 bp, Artificial Sequence
  Synthetic construct
gaggtgcagctggtgcagtctggaccagaggtgaaaaagccgggggagtctctgaagatctcctgtaagggttct

SEQ ID NO: 3973 - DNA, 75 bp, Artificial Sequence
  Synthetic construct
gaggtgcagctggtgcagtctggagcagaggtgaaaaagccgggggagtctctgaagatctcctgtaaggtctct

SEQ ID NO: 3974 - DNA, 75 bp, Artificial Sequence
  Synthetic construct
gaggtgcagttggtgcagtctggggctgaggtgaaaaggccgggggagtctctgaagatctcctgtcagggttct

SEQ ID NO: 3975 - DNA, 75 bp, Artificial Sequence
  Synthetic construct
gaggtgcagctggcgcagtctggggcagaggtgaaaaagccgggggaatctctgaagatctcctgtcaggcttct

SEQ ID NO: 3976 - DNA, 75 bp, Artificial Sequence
  Synthetic construct
gaggtgcagctggtgcagtctggagcagaggtgaaaaagccgggggagtctctgaacatttcctgtaagggttct

SEQ ID NO: 3977 - DNA, 75 bp, Artificial Sequence
  Synthetic construct
gaggtgcagctggtgcagtctggagcagaagtgaaaaagccgggggagtctctgaagatctcctgcaagggttct

SEQ ID NO: 3978 - DNA, 75 bp, Artificial Sequence
  Synthetic construct
caggtccaacttgtgcagtctggggctgaggtgaagaagcctggggcctcagtaaagatatcctgcaaggcttct

SEQ ID NO: 3979 - DNA, 75 bp, Artificial Sequence
  Synthetic construct
caggtccagctgctgcagtctggggctgaggtgaagaagcctgggtcctcggtgaaggtgtcctgcaagacctct

SEQ ID NO: 3980 - DNA, 75 bp, Artificial Sequence
  Synthetic construct
gaggtgcagctggtggagtccgggggaggcttggtacagcctggggggtccctgagactctcctgtgcagcctct

SEQ ID NO: 3981 - DNA, 75 bp, Artificial Sequence
  Synthetic construct
gaggtgcagttgttggagtctgggggagacttggtacagcctggggggtccctgagactctcctgtgcagcctct

SEQ ID NO: 3982 - DNA, 75 bp, Artificial Sequence
  Synthetic construct
gaggtgcagctggtggagtctgggggagacatggtacatcctggagggtccgtgagactctcctgtgtaggttct

SEQ ID NO: 3983 - DNA, 75 bp, Artificial Sequence
  Synthetic construct
gaggtgcagctggtggagtctgggggaggcttggtaaagcctggggggtcccttaaaatctcctgtgcagcctct

SEQ ID NO: 3984 - DNA, 75 bp, Artificial Sequence
  Synthetic construct
gaggcgaacctggtggcgtcggggggagggttggtacagcctggagggtccctgagactctcctgtgcagcctct

SEQ ID NO: 3985 - DNA, 75 bp, Artificial Sequence
  Synthetic construct
gaggtgcagctggtggagtctgggggaggcctggtcaagccgggggggtccctgagactctcctgttcagcctct

SEQ ID NO: 3986 - DNA, 75 bp, Artificial Sequence
  Synthetic construct
gaggtgcagctggtggagtctgggggaggcttggtacagcctggggggtccctgagactctcctgtgcagcctct

SEQ ID NO: 3987 - DNA, 75 bp, Artificial Sequence
  Synthetic construct
gaggtgcagctggtggactctgggggaggcttggtacagcctggagggtccctgagactcacctgtgcagcctct

SEQ ID NO: 3988 - DNA, 75 bp, Artificial Sequence
  Synthetic construct
gaggtgcagttgttggagtctgggggaggcttggtacagcctggggggtccctgagactctcctgtgcagcctct

SEQ ID NO: 3989 - DNA, 75 bp, Artificial Sequence
  Synthetic construct
gaagtgcagctgttggagtctgggggaggcttggtacagcccggggggtccctgagactctcctgtgcagcctct

SEQ ID NO: 3990 - DNA, 75 bp, Artificial Sequence
  Synthetic construct
gaggtacagctgttggagtctgggggaggcttggtacagcctggggggtccctgagactctcctgtgcagcctct

SEQ ID NO: 3991 - DNA, 75 bp, Artificial Sequence
  Synthetic construct
gaggtgcagctggtggagtctgggggaggcttggtacagcctggagggttcctgagactctcctgtgcagcctct

SEQ ID NO: 3992 - DNA, 75 bp, Artificial Sequence
  Synthetic construct
gcggtgcagttggtggagtctgggggaagcctggtcaagcctggggggtccctgagactctcctgtgcagcctct

SEQ ID NO: 3993 - DNA, 75 bp, Artificial Sequence
  Synthetic construct
gaggtgcaactggtggagtctgggggaggcctggtcaagcctggggggtccctgagactctcctgtgcagcctct

SEQ ID NO: 3994 - DNA, 75 bp, Artificial Sequence
  Synthetic construct
gaggtgcaactggtggagtctgggggaggcctggtcaagcctggggggtccctgagactctcctgtgcagtctct

SEQ ID NO: 3995 - DNA, 75 bp, Artificial Sequence
  Synthetic construct
gaggtgcagctggtggagtctgggggaggcccggtcaagcctggggggtccctgagactctcctgtgcagcctct

SEQ ID NO: 3996 - DNA, 75 bp, Artificial Sequence
  Synthetic construct
gaggtgcagctggtggagtctgggggaggcctggtcaagccgggggggtccctgagactctcctgtgcaggctct

SEQ ID NO: 3997 - DNA, 75 bp, Artificial Sequence
  Synthetic construct
gaggtgcagctggtggagtctgggggaggcctggtcaagcctggggggtccctgagactctcctgtacagcctct

SEQ ID NO: 3998 - DNA, 75 bp, Artificial Sequence
  Synthetic construct
gaggtgcagctggtggagtctgggggaggcctggtcaagcctggggggtccctgagactctcctgtgcagcctct

SEQ ID NO: 3999 - DNA, 75 bp, Artificial Sequence
  Synthetic construct
gaggtccaactggtgcagtcggggggaggcctggtcaagccgggggggtccctgagactctcctgtgcagcctca

SEQ ID NO: 4000 - DNA, 75 bp, Artificial Sequence
  Synthetic construct
gaattgcagctggtggagtctgggggaggcttggtacagcctggagggtccctgagactctcctgtgcggcctct

SEQ ID NO: 4001 - DNA, 75 bp, Artificial Sequence
  Synthetic construct
gacgtgcagctggtggagtctgggggaggcttggtacagcctggagggtccctgagactctcctgtgcagcctct

SEQ ID NO: 4002 - DNA, 75 bp, Artificial Sequence
  Synthetic construct
gaggaacaattgatggagtctgggggaggcttggtacagcctggagggtccctgagactctcctgtgtagcctct

SEQ ID NO: 4003 - DNA, 75 bp, Artificial Sequence
  Synthetic construct
gaggtgcagctggcggagtctgggggaggcttggtacagcctggagggtccctgagactctcctgtgcagcctct

SEQ ID NO: 4004 - DNA, 75 bp, Artificial Sequence
  Synthetic construct
gaggtgcagctggtggagtctgggggaggcctggtacagcctggagggtccctgagactctcctgtgcagcctct

SEQ ID NO: 4005 - DNA, 75 bp, Artificial Sequence
  Synthetic construct
gaggtgcagctggtggagtctgggggaggcttggtacagcctggagggtccctgagactctcctgcgcaacgtct

SEQ ID NO: 4006 - DNA, 75 bp, Artificial Sequence
  Synthetic construct
gaggtgcagctggtggagtctgggggaggcttggtacagcctggagggtccctgagactctcctgtgcagcctct

SEQ ID NO: 4007 - DNA, 75 bp, Artificial Sequence
  Synthetic construct
gacgtgcaattggtggaatctgggggaggcctggtcaagccgggggggtccctgagactctcctgtgttgcctct

SEQ ID NO: 4008 - DNA, 61 bp, Artificial Sequence
  Synthetic construct
ggggtctgggggagccttggtacagcctggagggtccctgcgactctcctgtttaggatct

SEQ ID NO: 4009 - DNA, 75 bp, Artificial Sequence
  Synthetic construct
gaggtgcagctggaggagtctgggggaggcttggtacagcctggagggtcccggagactctcctgtgcagcctct

SEQ ID NO: 4010 - DNA, 75 bp, Artificial Sequence
  Synthetic construct
gaggtgcagctggtggagtctgggggaggcttggtacagcctggagggtccctgagactctcctgtgccgcctct

SEQ ID NO: 4011 - DNA, 75 bp, Artificial Sequence
  Synthetic construct
gaggtgcagctggtggagtctggggggggcttggtaaagcctggagggtccctgagactctcctgtacaggctct

SEQ ID NO: 4012 - DNA, 75 bp, Artificial Sequence
  Synthetic construct
gaggtgcagttggtggagtctgggggaggcttggtacagcctggagggtccctgagactctcctgcacagcccct

SEQ ID NO: 4013 - DNA, 75 bp, Artificial Sequence
  Synthetic construct
gaggtgcagctggtggagtccgggggcggcctggtcaagcctggggggtccctgagactctcctgtgtagcctct

SEQ ID NO: 4014 - DNA, 75 bp, Artificial Sequence
  Synthetic construct
gaggtgcaactggtggagtctgggggcggcctggtcaagcctggggggtccctgagactctcctgtgcaggctct

SEQ ID NO: 4015 - DNA, 75 bp, Artificial Sequence
  Synthetic construct
caggtccacctggtggagtctgggggaggcttggtcaagcctggagggtccctgagactctcctgtgcagcctct

SEQ ID NO: 4016 - DNA, 75 bp, Artificial Sequence
  Synthetic construct
gaggtgcagctggtggagtctgggggaggcttggtcaagcctggagggtccctgagactctcttgtgcagtttct

SEQ ID NO: 4017 - DNA, 75 bp, Artificial Sequence
  Synthetic construct
gaggtgcgattggaggagtctgggggaggccacattgagccgggggggtccctgagactctcgtgttcagcctct

SEQ ID NO: 4018 - DNA, 75 bp, Artificial Sequence
  Synthetic construct
gacgtgcaactggtggagtctgggggaggcttggtacagcctggagggtccctgagactctcctgtgcagtctct

SEQ ID NO: 4019 - DNA, 75 bp, Artificial Sequence
  Synthetic construct
gaggtgcaactggtggagtctgggggaggcttggtgcagcctggcgggtccctgagactctcctgtacagcctct

SEQ ID NO: 4020 - DNA, 75 bp, Artificial Sequence
  Synthetic construct
gaggtgcagttggtggagtctgggggagccttggtccagcctggagagtccctcagactctcttgtgaagcctct

SEQ ID NO: 4021 - DNA, 75 bp, Artificial Sequence
  Synthetic construct
gaggtgcagctggtggagtctgggggaggcttggtgaagcctggggggtcccttagactctcctgtgcagcctct

SEQ ID NO: 4022 - DNA, 75 bp, Artificial Sequence
  Synthetic construct
gcggttcaactggtggaatctgggggaggcctggttcagcctggagggtccctgagactctcctgtgcagcctct

SEQ ID NO: 4023 - DNA, 75 bp, Artificial Sequence
  Synthetic construct
gaggtgcagctggtggagtctgggggaggcctggtcaagcctggggggtccctgagagtctcctgtgcagcctct

SEQ ID NO: 4024 - DNA, 75 bp, Artificial Sequence
  Synthetic construct
caggtgcagctggtgcaatctgggtctgagttgaagaagcctggggcctcagtgaaggtttcctgcaaggcttct

SEQ ID NO: 4025 - DNA, 75 bp, Artificial Sequence
  Synthetic construct
caggtgcggttggagcagtctggatctgagttgaagaagcctgggacctcagtgaaggtttcctgcaaggcttct

SEQ ID NO: 4026 - DNA, 75 bp, Artificial Sequence
  Synthetic construct
gaggtgcaactggtggagtctgggggaagtgtggtacggcctggggggtccctcagactctcctgtacagcctct

SEQ ID NO: 4027 - DNA, 75 bp, Artificial Sequence
  Synthetic construct
ggggtgcaattggtggagtctgggggaggtgtgatacggccgggggggtccctgagactctcctgtgcagcctcc

SEQ ID NO: 4028 - DNA, 75 bp, Artificial Sequence
  Synthetic construct
gaggtgcagctggtggaatctgggggaggcttggtgcagcctggggggtccctgagactctcctgtgcagcctct

SEQ ID NO: 4029 - DNA, 75 bp, Artificial Sequence
  Synthetic construct
gaggtgcagctgttggagtctgggggaggcttggtacagcccggggggtccctgagactctcctgtgcagtctct

SEQ ID NO: 4030 - DNA, 75 bp, Artificial Sequence
  Synthetic construct
gaggtgcaactggtggagtctgggggaggcttggttcagccagggcggtcccttagactctcctgtacagcttct

SEQ ID NO: 4031 - DNA, 75 bp, Artificial Sequence
  Synthetic construct
gaggtgcagttgttggagtctgggggaggcttggtgcagcctggggggtccctgagactctcgtgtgcagactct

SEQ ID NO: 4032 - DNA, 75 bp, Artificial Sequence
  Synthetic construct
gaggtgcagttgttggagtctgggggaggcttcgtacactctggggggtccctgagactctcctgtgcagcctct

SEQ ID NO: 4033 - DNA, 75 bp, Artificial Sequence
  Synthetic construct
gaggtgcagctggtggagtctgggggaggcttggtccagcctggggggtccctgagactctcctgtgtagcctct

SEQ ID NO: 4034 - DNA, 75 bp, Artificial Sequence
  Synthetic construct
gaggtgcagctgttggagtctgggggaggcatggtacagcctggggggtcccggagactctcctgtgcagcctct

SEQ ID NO: 4035 - DNA, 75 bp, Artificial Sequence
  Synthetic construct
gaggtgcagttgttggagtctgggggaggcttggtacagccgggggggtccctaagactctcctgttcaatgtct

SEQ ID NO: 4036 - DNA, 75 bp, Artificial Sequence
  Synthetic construct
gaggtgcaactggcggagtctggggggcgcttagtccgcccgggggagtccctgagactctcctgtgcagcctct

SEQ ID NO: 4037 - DNA, 75 bp, Artificial Sequence
  Synthetic construct
gaggtgcagctggtggagtctgggggaggcttggtacaccctggggggtccctgagactctcctgtgcagcctct

SEQ ID NO: 4038 - DNA, 75 bp, Artificial Sequence
  Synthetic construct
gaggtgcagctggtggagtctgggggaggcttggtccagcctggggggtccctgagactctcctgtgcagcctcc

SEQ ID NO: 4039 - DNA, 75 bp, Artificial Sequence
  Synthetic construct
gaggtgcagctggtggagtctgggggaggcttggtccagcctggggggtccctgagactctcctgtgcagcctcg

SEQ ID NO: 4040 - DNA, 75 bp, Artificial Sequence
  Synthetic construct
gaggtgcagctggtggagtctgggggaggcttggtccagcttggggggtctctgagactctcctgtgcagcctct

SEQ ID NO: 4041 - DNA, 75 bp, Artificial Sequence
  Synthetic construct
gaggtgcagctggtggagtctgggggaggcttcatacagcctggagggtccctgagactctcctgtgcagcctct

SEQ ID NO: 4042 - DNA, 75 bp, Artificial Sequence
  Synthetic construct
gaggtgcacctggtggaatcggggggagccgtggtacagccagggcggtccctgagactctcctgtacaggcact

SEQ ID NO: 4043 - DNA, 75 bp, Artificial Sequence
  Synthetic construct
gaggtgcagttgttggagtctgggggagacttggtacaccccggggggtccctgagactctcctgtgcagcctct

SEQ ID NO: 4044 - DNA, 75 bp, Artificial Sequence
  Synthetic construct
gaagtgaaactggtagaatctgggggaggcttggtccagccgggggggtccctgagactctcctgtgaagcctct

SEQ ID NO: 4045 - DNA, 75 bp, Artificial Sequence
  Synthetic construct
gaggtgcagctggtggaatctgggggaggcttggtacagccagggcggtccctgagactctcctgtaaagcctct

SEQ ID NO: 4046 - DNA, 75 bp, Artificial Sequence
  Synthetic construct
gaagggcagctggtggagtctgggggaggcctcgtccaggcgggggggtccctgagaatttcctgtgcggcctct

SEQ ID NO: 4047 - DNA, 75 bp, Artificial Sequence
  Synthetic construct
caggtgcagctggtggagtctgggggaggcttggtcaagcctggagggtccctaagactctcctgtgcagtctct

SEQ ID NO: 4048 - DNA, 75 bp, Artificial Sequence
  Synthetic construct
caggtgcgactggtggagtctgggggaggcttggtcgagcctggagggtccctgagactctcctgtgcagcctct

SEQ ID NO: 4049 - DNA, 75 bp, Artificial Sequence
  Synthetic construct
gaagggcagttgtcggagtccgggggaggcttggttcagccgggggggtccctgagactctcctgtgcagcctct

SEQ ID NO: 4050 - DNA, 75 bp, Artificial Sequence
  Synthetic construct
gaggtgcaactgttggagtctgggggaggcttggtacagcctggggggtccctgagaatctcctgtgcagcctct

SEQ ID NO: 4051 - DNA, 75 bp, Artificial Sequence
  Synthetic construct
caggtgcagctggtggagtctgggggaggcttggtcaagcctggagggtccctgagactctcctgtgcagcctct

SEQ ID NO: 4052 - DNA, 75 bp, Artificial Sequence
  Synthetic construct
caggtgcaactggtggagtctgggggaggcttggtcaagcctggagggtccctgagactctcctgtgtaggctct

SEQ ID NO: 4053 - DNA, 75 bp, Artificial Sequence
  Synthetic construct
caggtgcaactggtggagtctgggggaggcttggtcaagcctggagggtccctgagactctcctgtgcagcctct

SEQ ID NO: 4054 - DNA, 75 bp, Artificial Sequence
  Synthetic construct
gaggtgcagttggtggagtctgggggaagtgtggtacggccgggggggtccctgagactctcctgtgcagccgct

SEQ ID NO: 4055 - DNA, 75 bp, Artificial Sequence
  Synthetic construct
gacgctcaagttttggagtctgggggaggcttggtgcagcctggggggtccctgagactctcctgtgtcgcctct

SEQ ID NO: 4056 - DNA, 75 bp, Artificial Sequence
  Synthetic construct
gaggtgcagctggtggagtctgggggaggcttggtacagcctggggggaccctgagactctcctgtgcagcctct

SEQ ID NO: 4057 - DNA, 75 bp, Artificial Sequence
  Synthetic construct
gaggtgcagctgttggagtctgggggaggcttggtacagcctggggggtccctgagactctcctgtgtagcctct

SEQ ID NO: 4058 - DNA, 75 bp, Artificial Sequence
  Synthetic construct
gaggtgcagctggaggagtctgggggaggcttggtccagcctggggggtccctgagactctcctgtgcagcctct

SEQ ID NO: 4059 - DNA, 75 bp, Artificial Sequence
  Synthetic construct
gaggtgcagctggtggagtctgggggaggcttgataaagcctggggggtccctgagactctcctgcgtagcctct

SEQ ID NO: 4060 - DNA, 75 bp, Artificial Sequence
  Synthetic construct
gaggtgcagctggtggagtctgggggaggcttggtacagccagggcggtccctgagactctcctgtacagcttct

SEQ ID NO: 4061 - DNA, 75 bp, Artificial Sequence
  Synthetic construct
gaggtgaaactggaggagtccggaggaggcctggtccagccgggggggtcccaaagactctcctgtgcagcctct

SEQ ID NO: 4062 - DNA, 75 bp, Artificial Sequence
  Synthetic construct
gaggtgcaactggtggagtctggaggaggcttggtccagcctggggggtccctgagactctcctgtgcagcctct

SEQ ID NO: 4063 - DNA, 75 bp, Artificial Sequence
  Synthetic construct
gaggtgcagctagtggagtctgggggaggcttggtacagccgggggggtccctgagactctcctgtgcagcctct

SEQ ID NO: 4064 - DNA, 75 bp, Artificial Sequence
  Synthetic construct
gaggtgcaactggtggagtctgggggaaccttggtacagcctggggggtccctgagactctcctgtgcagcctct

SEQ ID NO: 4065 - DNA, 75 bp, Artificial Sequence
  Synthetic construct
gaggtgcagctgttggagtctgggggaggcttggttcagcctggggagtccctgagaatttcctgtgcagcctct

SEQ ID NO: 4066 - DNA, 75 bp, Artificial Sequence
  Synthetic construct
gaggtgcaacttgtggagtctgggggaggcttggtacaaccgggggggtccctgagactctcctgtgcagcctct

SEQ ID NO: 4067 - DNA, 75 bp, Artificial Sequence
  Synthetic construct
gaggtgcagctgttggagtctgggggaggcttggtacagcctggggggtccctgagactctcctgtgcagcctct

SEQ ID NO: 4068 - DNA, 75 bp, Artificial Sequence
  Synthetic construct
gaggtgcagttggtggagtctgggggaggcttggtacagcctggggggtccctgagactctcctgtgcagcctct

SEQ ID NO: 4069 - DNA, 75 bp, Artificial Sequence
  Synthetic construct
gaggtgcagctggtggagtctgggggaaccttggtacagcctggggggtccctgagactctcctgtgcagtctct

SEQ ID NO: 4070 - DNA, 75 bp, Artificial Sequence
  Synthetic construct
gaggtgcagctggcggaatctgggggagacttcgtacagccgggggggtccctgagactctcttgtgcagcctct

SEQ ID NO: 4071 - DNA, 75 bp, Artificial Sequence
  Synthetic construct
gaggtgcagctggtggagactggaggaggcttgatccagcctggggggtccctgagactctcctgtgcagcctct

SEQ ID NO: 4072 - DNA, 75 bp, Artificial Sequence; identical to SEQ ID NO: 1777
  Synthetic construct

SEQ ID NO: 4073 - DNA, 75 bp, Artificial Sequence
  Synthetic construct
gaggtgcagctggtggaatctgggggaggcttggtccagcctggggggtccctgagactctcctgtgcagcctct

SEQ ID NO: 4074 - DNA, 75 bp, Artificial Sequence
  Synthetic construct
gaggtgcagctggtggagtctgggggaggcttggtccagcccggggggtccctgagactctcttgtgcagcctct

SEQ ID NO: 4075 - DNA, 75 bp, Artificial Sequence
  Synthetic construct
gaggtgcagctggtggagtctgggggaggcttggtccagcctggggggtccctgagactctcctgtgcagcctct

SEQ ID NO: 4076 - DNA, 75 bp, Artificial Sequence
  Synthetic construct
gaggtgcagctggtggagtctgggggaggcttggtccagtctggggagtccctgagagtctcctgtgcagcctct

SEQ ID NO: 4077 - DNA, 75 bp, Artificial Sequence
  Synthetic construct
gagttgcgactggtggagtctgggggaggccgggtccagccgggggggtccctgagactctcctgtgcagcctct

SEQ ID NO: 4078 - DNA, 75 bp, Artificial Sequence
  Synthetic construct
gaggtgcagctggtggagtctgggggaggcttggtaaagcctggggggtcccttagactctcctgtgcagcctct

SEQ ID NO: 4079 - DNA, 75 bp, Artificial Sequence
  Synthetic construct
gaggtgcagctggtggagtttgggggaggcttggtaaagcctggggggtcccttagactctcctgtgcagcctct

SEQ ID NO: 4080 - DNA, 75 bp, Artificial Sequence
  Synthetic construct
gaggtgcaactggtggagtctgggggaggcttggtacagccagggcggtccctgagactctcctgtacagtctct

SEQ ID NO: 4081 - DNA, 75 bp, Artificial Sequence
  Synthetic construct
gaggtgcagctgttggagtctgggggaggcttggtacagccgggggggtccctgagactctcctgttcagcctct

SEQ ID NO: 4082 - DNA, 75 bp, Artificial Sequence
  Synthetic construct
gaggtgcagctggtggagtctgggggaggcttggtccagcctggggggtccctgagactctcttgtgcagcctct

SEQ ID NO: 4083 - DNA, 75 bp, Artificial Sequence
  Synthetic construct
gaggtgcagttggtggagtctgggggagacttggtccagcctggggggtccctgagactctcctgtgcagcctcc

SEQ ID NO: 4084 - DNA, 75 bp, Artificial Sequence
  Synthetic construct
gaggtgcagttggtggagaccggaggagagttgatccagcctggggggtccctgagactctcctgtgcggcctct

SEQ ID NO: 4085 - DNA, 75 bp, Artificial Sequence
  Synthetic construct
gaggtgaagttggcggagtctgggggaggcttggtccagcccggggggtccctgacactctcctgtgtagtctct

SEQ ID NO: 4086 - DNA, 75 bp, Artificial Sequence
  Synthetic construct
caggtgcagctggtggaatctgggggaggcttggtcaagcctggagggtccctgagactctcctgtgcagcctct

SEQ ID NO: 4087 - DNA, 75 bp, Artificial Sequence
  Synthetic construct
gaggtacaactagtggagtctgggggacgtgtggtacggccgggggagtccctgagactctcctgtgcagtctct

SEQ ID NO: 4088 - DNA, 75 bp, Artificial Sequence
  Synthetic construct
ggggtgcatctggtggagtctgggggaggcttggtccagcctggggggtccctgagactctcatgtgcagcctct

SEQ ID NO: 4089 - DNA, 75 bp, Artificial Sequence
  Synthetic construct
gaggtgcagttggtggagtcggggggagacttggtccaccctggagggtccctgagactctcctgtgaagcctct

SEQ ID NO: 4090 - DNA, 75 bp, Artificial Sequence
  Synthetic construct
gaggtgcagctggtggaatcggggggaggcttggtacagccagggcggtccctgagactctcctgttcagcttcc

SEQ ID NO: 4091 - DNA, 75 bp, Artificial Sequence
  Synthetic construct
gaggtgcagttgttggagtctgggggaggcttggtacggcctggggggtccctgagactctcctgtgcagcctct

SEQ ID NO: 4092 - DNA, 75 bp, Artificial Sequence
  Synthetic construct
gaggtgcaactggtggagtctgggggaggcttggtccagcctggggggtccctgagactctcttgtgcagcctct

SEQ ID NO: 4093 - DNA, 75 bp, Artificial Sequence
  Synthetic construct
gaggtgcaactggtggagtctgggggaggcttggtaaagcctggggggtcccttagactctcctgtgcagcctct

SEQ ID NO: 4094 - DNA, 75 bp, Artificial Sequence
  Synthetic construct
gaggtgcaactggtggagtctgggggaggcttggtccagccgggggggtccctgagactttcctgtgcagcctct

SEQ ID NO: 4095 - DNA, 75 bp, Artificial Sequence
  Synthetic construct
gaggtggaactggtggagtctgggggaggcttggtccagcctggggggtccctaagactctcctgtgaagcctct

SEQ ID NO: 4096 - DNA, 75 bp, Artificial Sequence
  Synthetic construct
gaggtgaggctggtggagtctgggggaggcttggttagacctggggaatctctcagaataacatgtgcagcctct

SEQ ID NO: 4097 - DNA, 75 bp, Artificial Sequence
  Synthetic construct
gaggtgatgttggtggagtctgggggaggcgtggtacagccgggggggtcattgagtcttacctgtgtggcctcc

SEQ ID NO: 4098 - DNA, 75 bp, Artificial Sequence
  Synthetic construct
caggtccagttggtgcagtctggggctgaggtgaagaagcctgggtcctcggtgaaggtctcctgtaagatttct

SEQ ID NO: 4099 - DNA, 75 bp, Artificial Sequence
  Synthetic construct
caggtgcagctggtggagtctgggggaggcttggtcaaacctggagggtccctgagactctcctgtgcagcctct

SEQ ID NO: 4100 - DNA, 75 bp, Artificial Sequence
  Synthetic construct
gaggtgcagctggtggagtctgggggagacttggtacagcggggggggtccttgagactctcctgtgcagcctct

SEQ ID NO: 4101 - DNA, 75 bp, Artificial Sequence
  Synthetic construct
gaggtgcagctggtggagtctgggggaggcttgatagagcctggagggtccctgagactctcttgtgtagcctct

SEQ ID NO: 4102 - DNA, 75 bp, Artificial Sequence
  Synthetic construct
gaggtccagctgctacagtccggggctgaggtgaagaagcctggggccaccgtgaaaatctcctgcaaggcttct

SEQ ID NO: 4103 - DNA, 75 bp, Artificial Sequence
  Synthetic construct
caggaacaactggtggagtctgggggaggcgtggtgcagcctgggatgtccctgagactttcctgtgcagcctct

SEQ ID NO: 4104 - DNA, 75 bp, Artificial Sequence
  Synthetic construct
gaggtgcagctggtggagtccgggggaggcttagttcagcctggggggtccctgagactctcctgtgcagcctct

SEQ ID NO: 4105 - DNA, 75 bp, Artificial Sequence
  Synthetic construct
gaggtgcagctggtggagtctgggggcggcctggtcaagccgggggggtcccttagactctcctgtgcagtgtca

SEQ ID NO: 4106 - DNA, 75 bp, Artificial Sequence
  Synthetic construct
gaggtgaacctggtggagtctgggggaggcttggcccagccgggggggtccctgagactctcctgtgcagcctct

SEQ ID NO: 4107 - DNA, 75 bp, Artificial Sequence
  Synthetic construct
caggtgcagctggtggagtcggggggaggcgtggtccagcctgggaggtccctgagactctcctgtgcagcctct

SEQ ID NO: 4108 - DNA, 75 bp, Artificial Sequence
  Synthetic construct
caggtgcagctggtggagtctgggggaggcgtggtccagcctgggaggtccctgagactctcctgtgcagcctct

SEQ ID NO: 4109 - DNA, 75 bp, Artificial Sequence
  Synthetic construct
caggtgaagctggtggagtctgggggaggcgtggtccagcctgggaggtccctgagactctcctgtgcagcctct

SEQ ID NO: 4110 - DNA, 75 bp, Artificial Sequence
  Synthetic construct
caggtgcggatggtgcagccgggaggaggcgtggtccagcctggggggtccctgacactctcctgtgatgtctct

SEQ ID NO: 4111 - DNA, 75 bp, Artificial Sequence
  Synthetic construct
caggtgcagctggtggagtctgggggaaccgtggtccagcctgggacatccctgagactctcctgtgcagcctct

SEQ ID NO: 4112 - DNA, 75 bp, Artificial Sequence
  Synthetic construct
caggtgcagttggtggagtctgggggaggcgtggtccagcctgggaggtccctgcgactctcctgtgcagcgtct

SEQ ID NO: 4113 - DNA, 75 bp, Artificial Sequence
  Synthetic construct
caggtgcacctggtggagtctgggggaggcgtggtccagcctgggaggtccctgagactctcctgtgcagcctcg

SEQ ID NO: 4114 - DNA, 75 bp, Artificial Sequence
  Synthetic construct
caggtgcagttggtggagtctgggggaggcgtggtccagcctgggaggtccctgagactctcctgtgcagcctct

SEQ ID NO: 4115 - DNA, 75 bp, Artificial Sequence
  Synthetic construct
caggtgcaactgatggagtctgggggaggcgtggtccagcctgggaggtccctgagactctcctgtgcagcctct

SEQ ID NO: 4116 - DNA, 75 bp, Artificial Sequence
  Synthetic construct
caggtgcggctggtggagtctgggggaggcgtggtccagcctgggaggtccctgagactctcctgtgcagcctct

SEQ ID NO: 4117 - DNA, 75 bp, Artificial Sequence
  Synthetic construct
caggtgcagttggtggagtctgggggaggcgtgctccagtctgggaggtccctgagactctcctgtgcagcctct

SEQ ID NO: 4118 - DNA, 75 bp, Artificial Sequence
  Synthetic construct
caggtgcagctggtggagtctgggggaggcgtggtccagcctgaaaagtccctgagactctcgtgtgcaacgtct

SEQ ID NO: 4119 - DNA, 75 bp, Artificial Sequence
  Synthetic construct
caggtgcagctggtggagtctgggggaggcgtggtccagcctgggaggtccctgagactctcctgtgcagcgtct

SEQ ID NO: 4120 - DNA, 75 bp, Artificial Sequence
  Synthetic construct
ctggcgcagttggtggagtctgggggaggcgcggtcgagcctgggaagtcactaagactgtcctgtgcagcgtct

SEQ ID NO: 4121 - DNA, 75 bp, Artificial Sequence
  Synthetic construct
caggtgcaactggtggagtctgggggaggcgtggtccagcctgggaggtccctgagactctcctgtgcagcctct

SEQ ID NO: 4122 - DNA, 75 bp, Artificial Sequence
  Synthetic construct
caggtgcaggtggtggagtctgggggaggcgtggtccagcctggggggtccctgagactctcctgtgaagcctct

SEQ ID NO: 4123 - DNA, 75 bp, Artificial Sequence
  Synthetic construct
caggtgcggcttttggagtctgggggaggcgtggtccagcctgggaagtccctgagactctcctgtgcagcctct

SEQ ID NO: 4124 - DNA, 75 bp, Artificial Sequence
  Synthetic construct
cagggacaactggtggagtctgggggaggcatggtccagcctggggggtccctgagactctcctgtgcagcctct

SEQ ID NO: 4125 - DNA, 75 bp, Artificial Sequence
  Synthetic construct
caggtgcagctgctcgaatctgggggagccgtggtccagcctgggaggtccctgagactctcctgtgcagccttt

SEQ ID NO: 4126 - DNA, 75 bp, Artificial Sequence
  Synthetic construct
caggtgcagttggtggagtctgggggaggcgtggtccagcctgggaggtccctgaggctcccctgtgcagcctct

SEQ ID NO: 4127 - DNA, 75 bp, Artificial Sequence
  Synthetic construct
caggtgcacctggtggagtccgggggaggcgtggtccagcctggggggtccctgagactctcctgtgtagcctct

SEQ ID NO: 4128 - DNA, 75 bp, Artificial Sequence
  Synthetic construct
caggtgcagctggtggagtctgggggaggcgtggtccagcctgggaagtccctgagactctcctgtgcagcctct

SEQ ID NO: 4129 - DNA, 75 bp, Artificial Sequence
  Synthetic construct
gaggtgcagctggtggagtccgggggaggcttggtccagcctggggggtccctgaaactctcctgtgcagcctct

SEQ ID NO: 4130 - DNA, 75 bp, Artificial Sequence
  Synthetic construct
gaagtgcagctggtggagtctgggggaggcttggtacagcctggcaggtccctgagactctcctgtgcagcctct

SEQ ID NO: 4131 - DNA, 75 bp, Artificial Sequence
  Synthetic construct
gaagtgcagctggtggagtctgggggaggcttggtacagcctggcaggtccctgagactctcctgtgtagcctct

SEQ ID NO: 4132 - DNA, 75 bp, Artificial Sequence
  Synthetic construct
gaagtgcagctggtggagtctgggggaggctgggtacagcctggcaggtccctgagactctcctgtgcagcctct

SEQ ID NO: 4133 - DNA, 75 bp, Artificial Sequence
  Synthetic construct
gaagtgcagctggtggagtctgggggaggcttggtacatcctggcaggtccctgagactctcctgtgcagcctct

SEQ ID NO: 4134 - DNA, 75 bp, Artificial Sequence
  Synthetic construct
gaggtgcacctggtggagtctgggggagtcgtggttcagcctggggggttcctgagactctcctgtgcagcctcg

SEQ ID NO: 4135 - DNA, 75 bp, Artificial Sequence
  Synthetic construct
gaagtgcagctggtggagtctgggggagtcgtggtacaccctggggggtccctgagactctcctgtgtagcctct

SEQ ID NO: 4136 - DNA, 75 bp, Artificial Sequence
  Synthetic construct
gaggtgcagctggtggaatctgggggaatcgtggtacagccgggggggtccctgacactctcctgtgcagcctct

SEQ ID NO: 4137 - DNA, 75 bp, Artificial Sequence
  Synthetic construct
gaggtccagctggtacagtccggggctgaggtgaagaagcctggggccaccgtgaaaatctcctgcaaggcttct

SEQ ID NO: 4138 - DNA, 75 bp, Artificial Sequence
  Synthetic construct
gaggtccagctgttacagtccgagactgaggtgaagaagtctggggccaccgtaaaaatctcctgcaaggcttct

SEQ ID NO: 4139 - DNA, 75 bp, Artificial Sequence
  Synthetic construct
gaggtccacttgctccagtccggggctgaggtgaagaagcctggggccaccgtgaaaatctcctgcagggcttcc

SEQ ID NO: 4140 - DNA, 75 bp, Artificial Sequence
  Synthetic construct
caggtgcagctggtgcagtctggggctgaggtgaagaagcctggggcctcagtgaaggtttcctgcgaggcatct

SEQ ID NO: 4141 - DNA, 75 bp, Artificial Sequence
  Synthetic construct
caggtgcagctgctgcagtctggggctgaggtgaaggagcctggggcctcagtgaaagtctcctgcaaggcatct

SEQ ID NO: 4142 - DNA, 75 bp, Artificial Sequence
  Synthetic construct
caggtgcaactggtgcagtctggggctgaggtgaggaagcctggggcctcagtgaaagtttcctgcaaggcgtct

SEQ ID NO: 4143 - DNA, 75 bp, Artificial Sequence
  Synthetic construct
caggtgcaggtggtgcagtctggggctgaggtgaagaagcctggggcctcagtgaaggtttcctgcaaggcatct

SEQ ID NO: 4144 - DNA, 75 bp, Artificial Sequence
  Synthetic construct
caggtgcagctggtgcagtctggggccgaggtgaagaaccctggggcctcagtgaaggtttcctgcaaggcatct

SEQ ID NO: 4145 - DNA, 75 bp, Artificial Sequence
  Synthetic construct
caggtgcagttggtgcagtctggggctgaagtgaagcagcctggggcctcagtgaaggtgtcctgcaaggcatct

SEQ ID NO: 4146 - DNA, 75 bp, Artificial Sequence
  Synthetic construct
caggtccagctggtacagtctggggctgaggtgaagaagcctggggcctcagtgaaggtctcctgcaaggtttcc

SEQ ID NO: 4147 - DNA, 75 bp, Artificial Sequence
  Synthetic construct
caggtccatcttgtgcagtctggggctgaggtgaagaagcctggggcctcagtgaaggtttcctgcaaggctact

SEQ ID NO: 4148 - DNA, 75 bp, Artificial Sequence
  Synthetic construct
caaatgcagctggtgcagtctgggcctgaggtgaagaagcctgggacctcagtgaaggtctcctgcaaggcttct

SEQ ID NO: 4149 - DNA, 75 bp, Artificial Sequence
  Synthetic construct
caggtgcagctggtggagtctgggggaggcgtggtccagcctggggggtccctgagactctcctgttcagcctct

SEQ ID NO: 4150 - DNA, 75 bp, Artificial Sequence
  Synthetic construct
caggtccagcttgtgcagtctggggctgaggtgaagaagcctggggcctcagtgaaggtttcctgcaagacttct

SEQ ID NO: 4151 - DNA, 75 bp, Artificial Sequence
  Synthetic construct
caggtccagcttgtgcagtctggggctgaggtgaagaggcctggggcctcagttaatctttcctgcgagacttct

SEQ ID NO: 4152 - DNA, 75 bp, Artificial Sequence
  Synthetic construct
gacgtccaagtggtacagtccggggctgaggtgaagaagcctggggccaccgtgaaaatctcctgtaaggcttct

SEQ ID NO: 4153 - DNA, 75 bp, Artificial Sequence
  Synthetic construct
gaggtgcaactggtggagtctgggggaggcctggtcaaatctggggggtccctgagactctcctgtgcagcctct

SEQ ID NO: 4154 - DNA, 75 bp, Artificial Sequence
  Synthetic construct
gaggtgcagctggtggagtctgggggaggcttggtccagcctggagggtccctgagactctcctgtgcagcctct

SEQ ID NO: 4155 - DNA, 75 bp, Artificial Sequence
  Synthetic construct
caggtccaactggtggagtctgggggaggcgtggtccagcctgggaggtccctgagactcgcctgtgaagcgtct

SEQ ID NO: 4156 - DNA, 75 bp, Artificial Sequence
  Synthetic construct
gaggtgcaactagtggagtctgggggagtcttgggacagccagggcggtccctgagactctcctgtacagcctct

SEQ ID NO: 4157 - DNA, 75 bp, Artificial Sequence
  Synthetic construct
gaggtgcagctggtggagactggaggaggcttgatccagccgggggggtccgtgagactctcctgtacagcctct

SEQ ID NO: 4158 - DNA, 75 bp, Artificial Sequence
  Synthetic construct
gaggtgcagttggtggagtctgggggaggcctggtcaaggcgggggggtccctgacactctcgtgtgaagcctcc

SEQ ID NO: 4159 - DNA, 75 bp, Artificial Sequence
  Synthetic construct
caggtgcaactggtggagtctgggggaggcatggtcatgcctggagggtccctgaggctctcctgtgcagcctct

SEQ ID NO: 4160 - DNA, 75 bp, Artificial Sequence
  Synthetic construct
gaggtgcaactggaggagtctgggggagggttggtccagcctggggggtccctgagactctcctgtttagcctct

SEQ ID NO: 4161 - DNA, 75 bp, Artificial Sequence
  Synthetic construct
gaggcacaactgctggagtcggggggagacgtggtacgtccggggggctccctgagactctcctgttcagcctct

SEQ ID NO: 4162 - DNA, 75 bp, Artificial Sequence
  Synthetic construct
gaggtgcagctggtggagtctgggggaggcctggtcaagcctggggggtccctgagactctcctgtgcagtctct

SEQ ID NO: 4163 - DNA, 75 bp, Artificial Sequence; identical to SEQ ID NO: 1776
  Synthetic construct

SEQ ID NO: 4164 - DNA, 75 bp, Artificial Sequence
  Synthetic construct
gaggtgcagctggtggaatctgggggagacttggtccagccgggggggtccttgagactctcctgtgcagcctct

SEQ ID NO: 4165 - DNA, 75 bp, Artificial Sequence
  Synthetic construct
gaggcggaattggtggaatctgggggacgcctggtcaagccgggggggtccgtcagactgtcttgtacagcctct

SEQ ID NO: 4166 - DNA, 75 bp, Artificial Sequence
  Synthetic construct
gaggtgcagttggtggagtctgggggaggcttggttcagccgggggggtccctgagactctcctgtgcagcctct

SEQ ID NO: 4167 - DNA, 75 bp, Artificial Sequence
  Synthetic construct
caggtccagctggtgcagtctggggctgaggtgaaggagcctgggtcctcggtgaaggtctcctgccagacttct

SEQ ID NO: 4168 - DNA, 75 bp, Artificial Sequence
  Synthetic construct
caggtgcaactggtgcagtctggggctgcggtgaagacgcctggggcctcagtgaaggtctcctgcaagacctct

SEQ ID NO: 4169 - DNA, 75 bp, Artificial Sequence
  Synthetic construct
caggtccagctggtgcaatctgaggctgaggtgaagaggcctgggtcctcggtcaaggtctcctgcagggcttct

SEQ ID NO: 4170 - DNA, 75 bp, Artificial Sequence
  Synthetic construct
gaaatgcaactggcgcagtctgggcccgaggtgagaaagcctggggcctcagtgagggtggcctgcaagacgtct

SEQ ID NO: 4171 - DNA, 75 bp, Artificial Sequence
  Synthetic construct
gaggtccagctcgtacagtccggggctgaggtgaagaagcctggggccaccgtgagaatctcctgcagggcttct

SEQ ID NO: 4172 - DNA, 75 bp, Artificial Sequence
  Synthetic construct
caggtgcaattggtgcagtctggggctgaggtgaagaagcctggggcctcagtgaaggtctcctgcaaggcttct

SEQ ID NO: 4173 - DNA, 75 bp, Artificial Sequence
  Synthetic construct
gaggtccagctggtgcagtccggggctgaggtgaagaagcctggggccaccgtgaaaatctcctgcaaggcctct

SEQ ID NO: 4174 - DNA, 75 bp, Artificial Sequence
  Synthetic construct
caggtgcaactggtgcaatctgggtctgaggtgaagaggactgggacctcagtgaaagtctcctgcaggacttct

SEQ ID NO: 4175 - DNA, 75 bp, Artificial Sequence
  Synthetic construct
caggtgcaactggtgcagtctggggctgaggtgaagaagcctggggcctcagtgaaggtctcctgcaaggcttct

SEQ ID NO: 4176 - DNA, 75 bp, Artificial Sequence
  Synthetic construct
caggtccgacttgtgcaatctggggctgaattgaagaagcctggggcctcagtgaaggtttcctgcaaggcttct

SEQ ID NO: 4177 - DNA, 75 bp, Artificial Sequence
  Synthetic construct
gcagtgcagctgttggagtctgggggaggcttggcacagccgggggggtccctgagactctcctgtgcagtctcc

SEQ ID NO: 4178 - DNA, 75 bp, Artificial Sequence; identical to SEQ ID NO: 1779
  Synthetic construct

SEQ ID NO: 4179 - DNA, 75 bp, Artificial Sequence
  Synthetic construct
gaggtccacctgctacagtccggggctgaggtgaagaagcctggggcctccgtgaaaatctcctgcaaggcttct

SEQ ID NO: 4180 - DNA, 75 bp, Artificial Sequence
  Synthetic construct
caggtccacctggtgcagtctggggcagaggtgaagaagccggggtcctcggtgaaggtctcctgccaggcatct

SEQ ID NO: 4181 - DNA, 75 bp, Artificial Sequence
  Synthetic construct
cagctccagctggagcagtctggggctgaggtgaagaggcctgggtccgcagtgaaggtctcctgcatggcttct

SEQ ID NO: 4182 - DNA, 75 bp, Artificial Sequence
  Synthetic construct
caggtccacctggagcagtctggggctgaggtgaagaagcctgggtcctcggtgaaggtctcctgcaaggcttct

SEQ ID NO: 4183 - DNA, 75 bp, Artificial Sequence
  Synthetic construct
gaggtgcaactggcggagtctgggggaggcctggtcaagcctggggggtccctgagactctcctgtgcagcctct

SEQ ID NO: 4184 - DNA, 75 bp, Artificial Sequence
  Synthetic construct
ggggtgcagctggtggagtctgggggaggcttggtacagcctggagggtccctgagactctcctgtgcagactct

SEQ ID NO: 4185 - DNA, 75 bp, Artificial Sequence
  Synthetic construct
caggtacaactggtgcaatctgggtctgagttgaagaagcctggggcctcagtgaaggtttcctgcaaggcttct

SEQ ID NO: 4186 - DNA, 75 bp, Artificial Sequence
  Synthetic construct
gaggtacagctggtggagtctgggggaggcttggtccaggctggggggtccctaagactctcctgtacagcctct

SEQ ID NO: 4187 - DNA, 75 bp, Artificial Sequence
  Synthetic construct
gagattcagttgttggagtctggaggaggcttggcacagcctggggggtccctgacactctcctgtgcagcctct

SEQ ID NO: 4188 - DNA, 75 bp, Artificial Sequence
  Synthetic construct
gaggtgcacctggtggagtctgggggaggcttggtccagcctggggggtccctgagactctcctgtacagcctct

SEQ ID NO: 4189 - DNA, 75 bp, Artificial Sequence
  Synthetic construct
gaggtgcaactggtggagtctgggggaggggtggttcagccagggcggtccctgagactctcctgtaaaggttct

SEQ ID NO: 4190 - DNA, 75 bp, Artificial Sequence; identical to SEQ ID NO: 1775
  Synthetic construct

SEQ ID NO: 4191 - DNA, 75 bp, Artificial Sequence
  Synthetic construct
gacgtgcagttggtggagtctgggggaggcttggtgaagccgggggggtcccttagactctcctgtgcagcctct

SEQ ID NO: 4192 - DNA, 12 bp, Artificial Sequence
  Synthetic construct
gggagaggttct

SEQ ID NO: 4193 - DNA, 75 bp, Artificial Sequence
  Synthetic construct
gaggtgcagctggtgcaatccggggggggcctggtgcagccagggcggtccctcagactctcctgtagaggttct

SEQ ID NO: 4194 - DNA, 75 bp, Artificial Sequence
  Synthetic construct
caggtgcagctggtacaatctggccctgagctgaagaagcctggggcctcagtgaaaatttcctgccaggcatct

SEQ ID NO: 4195 - DNA, 75 bp, Artificial Sequence
  Synthetic construct
caggtgcagctggtggagtctgggggaggcgtggtccagcctgggacgtccctgagactctcctgtgcaggctct

SEQ ID NO: 4196 - DNA, 75 bp, Artificial Sequence
  Synthetic construct
cagatcacgttgagggagtctggtcctgcggtggttctccccacacagaccctcacactgacctgcaccttctct

SEQ ID NO: 4197 - DNA, 75 bp, Artificial Sequence
  Synthetic construct
caggttcaccttgagcagtctggagatgaggtgaagaagcctggggcctcagtgaaggtctcctgcaagacttct

SEQ ID NO: 4198 - DNA, 75 bp, Artificial Sequence
  Synthetic construct
caggtgcaggtgctggagtctgggggaggcgtggtccagcctgggaggtccctgagactctcctgtgcagcctct

SEQ ID NO: 4199 - DNA, 75 bp, Artificial Sequence
  Synthetic construct
caggtgcagctggtgcagtctggggctgaagtgaagaagcctggggcctcagtgacggtctcctgcaaggcttct

SEQ ID NO: 4200 - DNA, 75 bp, Artificial Sequence
  Synthetic construct
caggtccaggtggtgcagtctggggctgaggtgaagaagcctgggtcctcggtgaaggtctcctgcgagactctt

SEQ ID NO: 4201 - DNA, 75 bp, Artificial Sequence
  Synthetic construct
caggtccagctggtgcagtctggggctgcgatgaagaagcctgggtcctcggtgagggtctcctgcaaggctgct

SEQ ID NO: 4202 - DNA, 75 bp, Artificial Sequence
  Synthetic construct
caggtcctgctggtgcagtctggggctgaggtgaagaagcctgggtcctcgataaaggtctcctgcaaggcttct

SEQ ID NO: 4203 - DNA, 75 bp, Artificial Sequence
  Synthetic construct
cagttcaccttgaaggagtctggtcctgtgctggtgaaacccacagagaccctcacgctgacctgcaccgtctct

SEQ ID NO: 4204 - DNA, 75 bp, Artificial Sequence
  Synthetic construct
caggtcaccttgagggagtctggtcctgcgctggtgaaacccacacagaccctcacactgacctgcaccttctct

SEQ ID NO: 4205 - DNA, 75 bp, Artificial Sequence
  Synthetic construct
caggtccaattgattcaatctgggcctgaggtgaagaagccggggtcctcgttgaaggtctcctgcaaggggtct

SEQ ID NO: 4206 - DNA, 75 bp, Artificial Sequence
  Synthetic construct
caggttcagttggtgcagtctggagctgaggtgcagaagcctggggcctcagtgaaggtctcctgcacggcctct

SEQ ID NO: 4207 - DNA, 75 bp, Artificial Sequence
  Synthetic construct
gaggtgcagttggtacagtctggaacagaggcgaagaagccgggggagtcgctgaagatctcctgtaaggcttct

SEQ ID NO: 4208 - DNA, 75 bp, Artificial Sequence
  Synthetic construct
caggtgcagctgcagccgtggggcgcaagactgttgaagccctcggagaccctgtccctcacgtgcgctgtgtct

SEQ ID NO: 4209 - DNA, 75 bp, Artificial Sequence
  Synthetic construct
gagatgcaggtggtggaatctggaggaggctgggtccggcctggggggtccctgagactctcctgtgcagcctct

SEQ ID NO: 4210 - DNA, 75 bp, Artificial Sequence
  Synthetic construct
gaggagcagctggtggagtctgggggaggcttggtacagccagggcggtccctgagactctcctgtacaggttct

SEQ ID NO: 4211 - DNA, 75 bp, Artificial Sequence
  Synthetic construct
caggtcaccttgagggagtctggtcctgcggtggtgaaacccacacagaccctcacactgacctgcaccgtctct

SEQ ID NO: 4212 - DNA, 75 bp, Artificial Sequence
  Synthetic construct
caggtcaccttgaaggagtctggtcctgtgctggtgaaacccacagagaccctcacgctgacctgcaccgtctct

SEQ ID NO: 4213 - DNA, 75 bp, Artificial Sequence
  Synthetic construct
caggtcaccttaaaggagtctggtcctgttctggtgaaacccacacagaccctcactctgacctgcgccttctct

SEQ ID NO: 4214 - DNA, 75 bp, Artificial Sequence
  Synthetic construct
caggtcaccttgaaggagtctggtcctgtgctggtgaaacccacacagaccctcacactgacctgcaccttctct

SEQ ID NO: 4215 - DNA, 75 bp, Artificial Sequence
  Synthetic construct
caggtcaccttgaaggagtctggtcctgtgctgctgaaacccacagagaccctcacgctgacctgcaccgtctcg

SEQ ID NO: 4216 - DNA, 75 bp, Artificial Sequence
  Synthetic construct
gaggtgcagctggtggagtcggggggaggcctggcacagccagggcggtcgctgacactctcctgcacgggttcc

SEQ ID NO: 4217 - DNA, 75 bp, Artificial Sequence
  Synthetic construct
caggtcaccttgagggagtctggtcctgcgctggtgaaatccacacagaccctcacactgacctgcaccttctct

SEQ ID NO: 4218 - DNA, 75 bp, Artificial Sequence
  Synthetic construct
gaggtcgttttgttggagtcgggggggggcttagtgcagccgggcgggtctctgagactctcctgtggaggctct

SEQ ID NO: 4219 - DNA, 75 bp, Artificial Sequence
  Synthetic construct
caggtcaccttgagggagtccggtcctgcgctggtgaaacccacacagaccctcacaatgacctgcaccttctct

SEQ ID NO: 4220 - DNA, 75 bp, Artificial Sequence
  Synthetic construct
cagatcaccttgaaggagtctggtcctacgctggtgaaacccacacagaccctcacgctgacctgcaccgtctct

SEQ ID NO: 4221 - DNA, 75 bp, Artificial Sequence
  Synthetic construct
cagatcaccttgcgggagtctggtccaacggtggtgaaacccacacagaccctcacgctgacctgcagcttttct

SEQ ID NO: 4222 - DNA, 75 bp, Artificial Sequence
  Synthetic construct
cagatcaccttgaaggagtctggtcctacgctggtgaaacccagacagaccctcacgctgacctgcaccttctct

SEQ ID NO: 4223 - DNA, 75 bp, Artificial Sequence
  Synthetic construct
cagatcaccttgaaggagtctggtcctacgctggtgaaacccacacagaccctcacgctgacctgcaccttctct

SEQ ID NO: 4224 - DNA, 75 bp, Artificial Sequence
  Synthetic construct
cagatcaccttggaggagtctggtcctgcgctggtgaaacccacacagaccctcacgctgacctgttccttgtct

SEQ ID NO: 4225 - DNA, 75 bp, Artificial Sequence
  Synthetic construct
cagatcaccttgaaggagtctggtcctacgctggtgaaagccacacagaccctcacgctgacctgcaccttctct

SEQ ID NO: 4226 - DNA, 75 bp, Artificial Sequence
  Synthetic construct
gaggtgcagttgttggagtcggggggagacttggttcagcctgggagatccctgagactctcgtgttcagcctct

SEQ ID NO: 4227 - DNA, 75 bp, Artificial Sequence
  Synthetic construct
gacgcgggcttggaggagtctgggggaggcttggtacagcctggcgggtccctgagactctcctgtgaaggttct

SEQ ID NO: 4228 - DNA, 75 bp, Artificial Sequence
  Synthetic construct
caggtgcagctgcaggagtcgggcccaggactggtgaagccttcggagaccctgtccctcacctgttctgtctct

SEQ ID NO: 4229 - DNA, 75 bp, Artificial Sequence
  Synthetic construct
caggtacagctgcagcagtcaggtccaggactggtgaagccctcgcagaccctctcactcacctgtgccatctcc

SEQ ID NO: 4230 - DNA, 75 bp, Artificial Sequence
  Synthetic construct
caggtgcagctgaaggagtcgggcccaggactggtgaagccttcacagaccctgtccctcacctgcgctgtctct

SEQ ID NO: 4231 - DNA, 75 bp, Artificial Sequence
  Synthetic construct
caggtgcagctgcaggagtcgggcccaggactggtgaagccttcggagaccctgtccctcatctgcactgtctct

SEQ ID NO: 4232 - DNA, 75 bp, Artificial Sequence
  Synthetic construct
caggtgcagctacaacagtggggcgcaggactgctgaagccttcggagaccctgtccctcacctgcgctgtctat

SEQ ID NO: 4233 - DNA, 75 bp, Artificial Sequence
  Synthetic construct
caggtgcagctacaacagtggggcgcaggactgctgaagctttcggagaccctgtccctcacctgcgctgtctat

SEQ ID NO: 4234 - DNA, 75 bp, Artificial Sequence
  Synthetic construct
caggtgcagctacagcagtggggcgcaggactgttgaagccttcggagaccctgtccctcacctgcactgtttct

SEQ ID NO: 4235 - DNA, 75 bp, Artificial Sequence
  Synthetic construct
cacgtgcagctgcaagaatcgggcccaggactggtgaagccttcggagaccctgtccctcacctgcactgtctct

SEQ ID NO: 4236 - DNA, 75 bp, Artificial Sequence
  Synthetic construct
caggtgcagctgcaggagtcgggcccaggactggtgaaggcttcacagaccctgtccctcacctgcactgtctct

SEQ ID NO: 4237 - DNA, 75 bp, Artificial Sequence
  Synthetic construct
caggtgcagctgcaggagtcgggcccaggactggtgaagccttcacagaccctgtccctcacctgcagtctctct

SEQ ID NO: 4238 - DNA, 75 bp, Artificial Sequence
  Synthetic construct
caggtgcaactgcaggagtcgggcccaggactggtgaagtcttcagagaccctgtccctcacttgcactgtctct

SEQ ID NO: 4239 - DNA, 75 bp, Artificial Sequence
  Synthetic construct
caggtgcagctgcaggagtcgggcccaggactggtgaagccttcacagaccctctccctcacctgcactgtctct

SEQ ID NO: 4240 - DNA, 75 bp, Artificial Sequence
  Synthetic construct
caggtgcagctgcaggagtcgggcccaggactggtgaagccctcggagaccctgtcactcacgtgcagtgtctct

SEQ ID NO: 4241 - DNA, 75 bp, Artificial Sequence
  Synthetic construct
caggtgcagctgcaggcgtcgggcccaggactggtgaagccttcggagaccctgtccctcacctgcagtgtgtca

SEQ ID NO: 4242 - DNA, 75 bp, Artificial Sequence
  Synthetic construct
caggtgaaattgcaggagtcgggcccaggagtggtgaagccttcggagaccctgtccctcacctgcactgtcccc

SEQ ID NO: 4243 - DNA, 75 bp, Artificial Sequence
  Synthetic construct
caggtgcagctactcgagtcgggcccaggactggtgaagccttcggggaccctgtccctcgcctgcagtgtctct

SEQ ID NO: 4244 - DNA, 75 bp, Artificial Sequence
  Synthetic construct
caggtgcagctacagcagtggggcgcaggactgttgaagccttcggagaccctgtccctcacctgcggtgtttat

SEQ ID NO: 4245 - DNA, 75 bp, Artificial Sequence
  Synthetic construct
caggtgcagctgcaggagtcgggcccaggactggtgaagccttcggagaccctgtccctcacctgcactgtctct

SEQ ID NO: 4246 - DNA, 75 bp, Artificial Sequence
  Synthetic construct
caggtgcagctgcaggagtcgggcccaggactggtgaagccttcggagaccctgtccctcgcctgcagtgtctct

SEQ ID NO: 4247 - DNA, 75 bp, Artificial Sequence
  Synthetic construct
caggtgcagctgcaggagtcgggccccggactggtgaggccttcggagaccctgtccctcacctgctctgtctct

SEQ ID NO: 4248 - DNA, 75 bp, Artificial Sequence
  Synthetic construct
caggtgcagctgcaggagtcgggcccaggactggtgaagtcttcacagaccctgtccctcacctgcactgtctcc

SEQ ID NO: 4249 - DNA, 75 bp, Artificial Sequence
  Synthetic construct
caggtgcagctgcaggagtcgggcccaggactggtgaagccttcacagaccctgtccctcacctgcactgtctct

SEQ ID NO: 4250 - DNA, 75 bp, Artificial Sequence
  Synthetic construct
caggtgcagctgcaggagtcgggcccaggactggtgcagccatcacagaccctgtccctcacctgcactgtctct

SEQ ID NO: 4251 - DNA, 75 bp, Artificial Sequence
  Synthetic construct
cgggtgcagctgcaggagtcgggcccaggagtggtgaagtcttcggagaccctgtccctcacctgcagtgtctct

SEQ ID NO: 4252 - DNA, 75 bp, Artificial Sequence
  Synthetic construct
caggtgcagctgcaggagtcgggcccaggactggtgaggcctggggagaccctgtccctcacctgcactgtctct

SEQ ID NO: 4253 - DNA, 75 bp, Artificial Sequence
  Synthetic construct
caggtacagctgcaggagtcgggcccagggctggtgaagccttcacagaccctgtccctcacctgcactgtctct

SEQ ID NO: 4254 - DNA, 75 bp, Artificial Sequence
  Synthetic construct
caggtgcagctgcaggagtcgggcccgggactggtgaggccctcagagaccctgtccctcatgtgctcggtctcg

SEQ ID NO: 4255 - DNA, 75 bp, Artificial Sequence
  Synthetic construct
caggtgcagctacagcagtggggcgcaggtctgttgaagccttcggagaccctgtccctcacctgcgctgtctat

SEQ ID NO: 4256 - DNA, 75 bp, Artificial Sequence
  Synthetic construct
caggtgcagctacagcagtggggcgcaggactgttgaagccttcggagaccctgtccctcacctgcgctgtctct

SEQ ID NO: 4257 - DNA, 75 bp, Artificial Sequence
  Synthetic construct
caggagcaattacagcagtggggcgcaggactgttgaagccttcggagaccctgtccctcacctgcgctgcctat

SEQ ID NO: 4258 - DNA, 75 bp, Artificial Sequence
  Synthetic construct
caggtgcagctacagcagtggggcgcaggactgttgaagccttcggagaccctgtccctcacctgcgctgtctat

SEQ ID NO: 4259 - DNA, 75 bp, Artificial Sequence
  Synthetic construct
caggtgcaggtacagcagtggggcgcaggactgttgaagccttcggagaccctgtccctcacctgcgctgtctat

SEQ ID NO: 4260 - DNA, 75 bp, Artificial Sequence
  Synthetic construct
caggtgcagctgcagcagtggggcgcaggcctgttgaagccttcggagaccctgtcactcacctgcgctgtctat

SEQ ID NO: 4261 - DNA, 75 bp, Artificial Sequence
  Synthetic construct
caggtgcggcttcagcagtggggcgcaggactgttgaagccttcggagaccctgtccctcacctgcgctgtctat

SEQ ID NO: 4262 - DNA, 75 bp, Artificial Sequence
  Synthetic construct
caggtgcagctacagcagtggggcccaggactgttgaagccttcggagaccctgtccctcacctgcgctgtttct

SEQ ID NO: 4263 - DNA, 75 bp, Artificial Sequence
  Synthetic construct
caagtacagctacaacagtggggcgcaggactgttgaagccttcggagaccctgtctctcatctgtgctgtctat

SEQ ID NO: 4264 - DNA, 75 bp, Artificial Sequence
  Synthetic construct
caggtgcagctccaacaatggggcgcaagactgttgaagccttcggagaccctgtccctcacctgcgctgtctat

SEQ ID NO: 4265 - DNA, 75 bp, Artificial Sequence
  Synthetic construct
caggtgcagctgcaggagtcgggcccaggactggtgaagccttcacagaccctgttcctcacctgcgatgtctct

SEQ ID NO: 4266 - DNA, 75 bp, Artificial Sequence
  Synthetic construct
cagctgcagctgcaggagtccggctcaggactggtgaagccttcacagaccctgtccctcacctgcgctgtctct

SEQ ID NO: 4267 - DNA, 75 bp, Artificial Sequence
  Synthetic construct
caggtgcagctgcaggagtcgggcccgggactggtgaagccttcacagaccctgtccctcacctgctctgtctct

SEQ ID NO: 4268 - DNA, 75 bp, Artificial Sequence
  Synthetic construct
caggtgcacctgcaggagtcgggcccaggactggtgaagccctcggcgaccctgtccctcacctgcaatgtctct

SEQ ID NO: 4269 - DNA, 75 bp, Artificial Sequence
  Synthetic construct
caggtgcagctgcaggagtcgggcccaggactggtgaagccttcggagaccctgtctctcacctgcagtgtctct

SEQ ID NO: 4270 - DNA, 75 bp, Artificial Sequence
  Synthetic construct
caggtgcacctgcaggagtcgggcccaggactggtgaagccttcggagaccctgtccctcacctgcactgtctct

SEQ ID NO: 4271 - DNA, 75 bp, Artificial Sequence
  Synthetic construct
caggtgcagctgcaggagtcgggcccgggactggtgaagccttcggagaccctgtccctcacctgcactgtctct

SEQ ID NO: 4272 - DNA, 75 bp, Artificial Sequence
  Synthetic construct
caggtgcaactactggagtcgggcccaggactggtgaagccttcacagaccctgtccctcacctgcaatgtctct

SEQ ID NO: 4273 - DNA, 75 bp, Artificial Sequence
  Synthetic construct
caggtgcagctgcaggagtcggggccaggactggtgaagccttcacagaccctgtccctcacttgcactgtctct

SEQ ID NO: 4274 - DNA, 75 bp, Artificial Sequence
  Synthetic construct
caggtgcagctgcaggagtcgggcccaggactggtgaagccttcggagaccctgtccctcacctgcagtgtctct

SEQ ID NO: 4275 - DNA, 75 bp, Artificial Sequence
  Synthetic construct
caagtgcagctgcaggagtcgggcccaggactggtaaagccttcggagaccctgtccgtcacctgcactgtctct

SEQ ID NO: 4276 - DNA, 75 bp, Artificial Sequence
  Synthetic construct
caggtgcagctacaggagtcgggcccaggactggtgaagccttcggagaccctgtccctcacctgcaatgtctct

SEQ ID NO: 4277 - DNA, 75 bp, Artificial Sequence
  Synthetic construct
caggtgcagctgcaggagtcgggcccaggactggtgaaaccttcggagaccctgtccctcacctgcactgtctct

SEQ ID NO: 4278 - DNA, 75 bp, Artificial Sequence
  Synthetic construct
caggtgcagctacagcagtggggcggaggactcttgaagccttcggagaccctgtccctcacctgcggtgtctat

SEQ ID NO: 4279 - DNA, 75 bp, Artificial Sequence
  Synthetic construct
ctggtgcagctgcaggagtcgggcccaggactggtgaagccttcggagaccctgtccctcacctgcactgtctct

SEQ ID NO: 4280 - DNA, 75 bp, Artificial Sequence
  Synthetic construct
caggtgcagttgcaggagtcgggcccaggactggtaaagccttcggagaccctgtccctcacttgctctgtctct

SEQ ID NO: 4281 - DNA, 75 bp, Artificial Sequence
  Synthetic construct
caggtgcaactgcaacagtggggcgcaggagtgttgaagccttcggagaccctgtccctcacctgcgctgtcgat

SEQ ID NO: 4282 - DNA, 75 bp, Artificial Sequence
  Synthetic construct
caggtgcaaatacaacagtggggcgcaggactgttgaagccttcggagaccctgtccctcacctgcgctgtctat

SEQ ID NO: 4283 - DNA, 75 bp, Artificial Sequence
  Synthetic construct
caggtgcagctacagcagtggggcgcaggactgttgaagccttcggagaccctgtccctcacctgcggtgtctat

SEQ ID NO: 4284 - DNA, 75 bp, Artificial Sequence
  Synthetic construct
caggtgcagctacagcagtggggcgcaggactgttgaagtcttcggagaccctgtccctcacctgcgctgtttat

SEQ ID NO: 4285 - DNA, 75 bp, Artificial Sequence
  Synthetic construct
caggtgcaattacagcagtggggcggaggactgttgaagccttcggagaccccgtccctcacctgcggtgtctct

SEQ ID NO: 4286 - DNA, 75 bp, Artificial Sequence
  Synthetic construct
caggtgcagctgcaggagtcgggcccaggactggtgaagccttcgcagaccgtgtccctcacctgtgctgtctct

SEQ ID NO: 4287 - DNA, 75 bp, Artificial Sequence
  Synthetic construct
caggtgcacctgcaggagtcgggcccaggactggtgaagccttcggcgaccctgtccctcacctgcaatgtctct

SEQ ID NO: 4288 - DNA, 75 bp, Artificial Sequence
  Synthetic construct
caggtgcaaatacaagagtcgggcccaggactggtgaggccttcggagaccctgtcgctcacctgcagtgtctct

SEQ ID NO: 4289 - DNA, 75 bp, Artificial Sequence
  Synthetic construct
caggtgcagctgcagcagtggggcgcagggctgttgaagccttcggagaccctgtccctcacctgcgctgtgtat

SEQ ID NO: 4290 - DNA, 75 bp, Artificial Sequence
  Synthetic construct
catcttctactacaggagtcgggcccaggactagtaaagccttgggagaccctgtccctcagttgcactgtctct

SEQ ID NO: 4291 - DNA, 75 bp, Artificial Sequence
  Synthetic construct
caggtgcagctgcaggagtcgggcccaggactggtgaagccttcacagaccctgtccctcacttgcactgtctcg

SEQ ID NO: 4292 - DNA, 75 bp, Artificial Sequence
  Synthetic construct
caggtgcacctgcaggagtcgggcccaggactggtgaagacttcggaaaccctgtccctcacctgcgttgtttct

SEQ ID NO: 4293 - DNA, 75 bp, Artificial Sequence
  Synthetic construct
cagctgcaacttcaggagtcgggcccaagactcttgaggccttcggagaccctgtccctcacctgcgctgtctct

SEQ ID NO: 4294 - DNA, 75 bp, Artificial Sequence
  Synthetic construct
caactgcagctgcaggagtcgggcccagggctggtgaagccctcggagaccctgtccctcacctgcactgtctct

SEQ ID NO: 4295 - DNA, 75 bp, Artificial Sequence
  Synthetic construct
cagctgcagctgcaggagtcgggcccaggactggtgaagccctcggagaccctgtccctcacctgcactgtctct

SEQ ID NO: 4296 - DNA, 75 bp, Artificial Sequence
  Synthetic construct
cacctgcagctgcaggggtcggacccaggactggtgaagccttcggagaccctgtccctcacctgcactgtctct

SEQ ID NO: 4297 - DNA, 75 bp, Artificial Sequence
  Synthetic construct
cagctgcagctgcaggagtcgggcccaggactggtgaagccttcggagaccctgtccctcacctgcactgtctct

SEQ ID NO: 4298 - DNA, 75 bp, Artificial Sequence
  Synthetic construct
cagctgcagctgcaggagtcgggcccaggactggtgaagccttcggagaccctgtccctcacctgcactgtctca

SEQ ID NO: 4299 - DNA, 75 bp, Artificial Sequence
  Synthetic construct
cagctgcagctgcaggagtcgggcccaggactggtgaagccttcggagaccctgttcctcacctgctctgtctct

SEQ ID NO: 4300 - DNA, 75 bp, Artificial Sequence
  Synthetic construct
cagctgcagctgcaggagtcgggcccaggactggtgaggccttcggagaccctgtccctcacctgctctgtctct

SEQ ID NO: 4301 - DNA, 75 bp, Artificial Sequence
  Synthetic construct
caggtgcagctgcaggagtcgggcccaggactggtgaggccttcggagaccctgtccctcacctgcactgtctct

SEQ ID NO: 4302 - DNA, 75 bp, Artificial Sequence
  Synthetic construct
caggtgcagctgcaggagtcgggcccaggaccggtgaagccttcggagaccctgtccctcacctgcacagtctct

SEQ ID NO: 4303 - DNA, 75 bp, Artificial Sequence
  Synthetic construct
caggtgcagctgcaggagtcgggccccggcctggtgaagccttcggagaccctgtccctcacctgcgctgtctct

SEQ ID NO: 4304 - DNA, 75 bp, Artificial Sequence
  Synthetic construct
caggtgcagctgcaggagtcggggccaggactggtgaagccttcggagaccctgtccctcacctgcgctgtctct

SEQ ID NO: 4305 - DNA, 75 bp, Artificial Sequence
  Synthetic construct
caggtgcagttgcaggagtcgggcccaggactggtgaagccttcggagaccctgtccctcacctgcgctgtctct

SEQ ID NO: 4306 - DNA, 75 bp, Artificial Sequence
  Synthetic construct
cacgtgcagctgcaagagtggggcccaggactggtgaagccttcggagaccctgtccctaacctgcgttgtctct

SEQ ID NO: 4307 - DNA, 75 bp, Artificial Sequence
  Synthetic construct
caggtgcagctgcaggagtcgggcccacgactggtgaagtcttcggagaccctgtccctcacctgcgctgtctct

SEQ ID NO: 4308 - DNA, 75 bp, Artificial Sequence
  Synthetic construct
caggtgcagctgcaggagtcgggcccaggactggtgaagccttcggagaccctgtccctcagttgtgttgtctct

SEQ ID NO: 4309 - DNA, 75 bp, Artificial Sequence
  Synthetic construct
caggtgcagcttcaggagtcgggcccaggactggtgaagccttcggagaccctgtccctcacctgcgctgtctct

SEQ ID NO: 4310 - DNA, 75 bp, Artificial Sequence
  Synthetic construct
caggtgcagctgcaggagtcgggcccaggactggtgaagccttcggagaccctgtccctcacctgcgctgtctct

SEQ ID NO: 4311 - DNA, 75 bp, Artificial Sequence
  Synthetic construct
caggtgcagcttcaggagtcgggcccaggactggtgaagccttcggagaccctgtccctcacctgcactgtctct

SEQ ID NO: 4312 - DNA, 75 bp, Artificial Sequence
  Synthetic construct
caggtgcagctgcaggagtcgggcccaggactggtgaagccttcggaaaccctgtccctcacctgcgctgtctct

SEQ ID NO: 4313 - DNA, 75 bp, Artificial Sequence
  Synthetic construct
cagatacaactacaagagtcgggcccaggactggtgaagccttcggagaccctgtccctcacctgcgctgtctct

SEQ ID NO: 4314 - DNA, 75 bp, Artificial Sequence
  Synthetic construct
caggtgcaactgcaggagtcgggcccacgactggtgaagccttcggagaccctgtccctctcctgcactgtgtct

SEQ ID NO: 4315 - DNA, 75 bp, Artificial Sequence
  Synthetic construct
caggtgcagctgcaggagtcgggcccaggactggtgaggccttcggagaccctgtccctcgcctgcgctgtgtct

SEQ ID NO: 4316 - DNA, 75 bp, Artificial Sequence
  Synthetic construct
cagctgcagctgcaggagtcgggcccaggactggtgaagccctcggagaccctgtccctcacctgcactgtgact

SEQ ID NO: 4317 - DNA, 75 bp, Artificial Sequence
  Synthetic construct
caggtgcagctgcaggagtcgggcccaggactggtgaagccttcggagaccctgtccctcacctgcgttgtctct

SEQ ID NO: 4318 - DNA, 75 bp, Artificial Sequence
  Synthetic construct
caggtgcagctgcaggaatcggggccaggactggtgaagtcttcggagaccctgtccctcagctgtactgtctct

SEQ ID NO: 4319 - DNA, 75 bp, Artificial Sequence
  Synthetic construct
caggtccagctggtgcagtctggggctgaggtgaggaagcctgggtcctcggtgaaggtctcctgcaaggcttcc

SEQ ID NO: 4320 - DNA, 75 bp, Artificial Sequence
  Synthetic construct
caggtcccgctggtgcagtctggggccgaactgaagaagcctgggtcctcggtgacggtctcctgcgaggcttct

SEQ ID NO: 4321 - DNA, 75 bp, Artificial Sequence
  Synthetic construct
caggtccaactggtgcagtctggggctgaggtgaagaggcctgggtcctcggtgaaggtctcctgcaagactcct

SEQ ID NO: 4322 - DNA, 75 bp, Artificial Sequence
  Synthetic construct
caggtccagctggtgcagtctggggctgaggtgaagatgcctgggtcgtcggtgaaggtctcctgcagggcttct

SEQ ID NO: 4323 - DNA, 75 bp, Artificial Sequence
  Synthetic construct
cgggttctgctggtgcagtctggatctgagctgaagaagcctggggcctcagtgaaggtctcctgcaagacctct

SEQ ID NO: 4324 - DNA, 75 bp, Artificial Sequence
  Synthetic construct
gaggtgcagctggtggagtctgggggaggcctggtcgagcctggggggtccctgagactctcttgtataacctca

SEQ ID NO: 4325 - DNA, 75 bp, Artificial Sequence
  Synthetic construct
gaggtccagttggtacagtccggggctgaggtgaagaggcctggggccaccgtgaaaatctcctgcaaggcttct

SEQ ID NO: 4326 - DNA, 75 bp, Artificial Sequence; identical to SEQ ID NO: 1780
  Synthetic construct

SEQ ID NO: 4327 - DNA, 75 bp, Artificial Sequence
  Synthetic construct
caggcgcagctggtggagtcggggggaggcttggtcaagcctggagggtctctgagactctcgtgtatagcctct

SEQ ID NO: 4328 - DNA, 75 bp, Artificial Sequence
  Synthetic construct
gacgtgcagctggtggagtctgggggaggcgtggcacggcctggggggtccctgagactctcctgtgaagcttct

SEQ ID NO: 4329 - DNA, 75 bp, Artificial Sequence
  Synthetic construct
caggtgcagctggtggaatctgggggaggcttggtcaagcctggagggtccctcagactctcctgtgcggcctcc

SEQ ID NO: 4330 - DNA, 75 bp, Artificial Sequence
  Synthetic construct
caggtgcagctggtggagtctgggggaggcgtggtccagcctgggaggtccctgaggctctcctgtgcagcctct

SEQ ID NO: 4331 - DNA, 75 bp, Artificial Sequence
  Synthetic construct
caggtgcaactggtgcagtctggggctgaggtgaagaagcctggggcctcagtggaggtctcctgcaaggcttct

SEQ ID NO: 4332 - DNA, 75 bp, Artificial Sequence
  Synthetic construct
caggtccagttggtacagtctggggctgaggtgaagaggcctggggcctcagtgaaggtctcctgcaaactttcc

SEQ ID NO: 4333 - DNA, 75 bp, Artificial Sequence
  Synthetic construct
cagatcaccttgaaggagtctggtccaacgcttgtagaggccacacagaccctcacgctgacctgcaccttctct

SEQ ID NO: 4334 - DNA, 75 bp, Artificial Sequence
  Synthetic construct
caggtccaattgctgcagtctggggctgaggtgaagacgcctgggtcctcagtgaaaatctcctgcacggcttct

SEQ ID NO: 4335 - DNA, 6 bp, Artificial Sequence
  Synthetic construct
ggggaa

SEQ ID NO: 4336 - DNA, 27 bp, Artificial Sequence
  Synthetic construct
ggacaagggcttgaatggattggaggc

SEQ ID NO: 4337 - DNA, 45 bp, Artificial Sequence
  Synthetic construct
gggatccggcagcccgccgggaagggactggagtggattgggcga

SEQ ID NO: 4338 - DNA, 51 bp, Artificial Sequence
  Synthetic construct
accatctgggtgcgacaggcccctggacaagggcttgagtggatgggatgg

SEQ ID NO: 4339 - DNA, 51 bp, Artificial Sequence
  Synthetic construct
ataaactgggtgcgacaggcccctggacaagggcttgagtggatggccata

SEQ ID NO: 4340 - DNA, 51 bp, Artificial Sequence
  Synthetic construct
ataagctggctgcgacaggcccctggacaaggactcgaatggatgggagga

SEQ ID NO: 4341 - DNA, 51 bp, Artificial Sequence
  Synthetic construct
atacactgggtccgccaggcccccgggaaagggctggagtgggttggccgt

SEQ ID NO: 4342 - DNA, 51 bp, Artificial Sequence
  Synthetic construct
atacactgggtccgccaggctccaggcaaggggccggagtgggtggcagtt

SEQ ID NO: 4343 - DNA, 51 bp, Artificial Sequence
  Synthetic construct
atacactgggtccgccaggctccaggcaaggggctggagtgggtgtcactt

SEQ ID NO: 4344 - DNA, 51 bp, Artificial Sequence
  Synthetic construct
atacactgggtccgccaggcttccgggaaagggctggagtggcttgcccgt

SEQ ID NO: 4345 - DNA, 51 bp, Artificial Sequence
  Synthetic construct
atacactgggtccgccaggcttccgggaaagggctggagtgggtcggccgc

SEQ ID NO: 4346 - DNA, 51 bp, Artificial Sequence
  Synthetic construct
atacactgggtccgccaggcttccgggaaggggctgcagtgggttggccat

SEQ ID NO: 4347 - DNA, 51 bp, Artificial Sequence
  Synthetic construct
atacactgggtgaagcaggcccctggaaaagggcttgagtggatgggacgt

SEQ ID NO: 4348 - DNA, 51 bp, Artificial Sequence
  Synthetic construct
atacactgggtgcgacaggcccctggacaagggcttgactggatgggaatt

SEQ ID NO: 4349 - DNA, 51 bp, Artificial Sequence
  Synthetic construct
atacactgggtgcgacaggcccctggacaagggcttgagtggatgggatgg

SEQ ID NO: 4350 - DNA, 51 bp, Artificial Sequence
  Synthetic construct
atacactgggtgcgacaggcccctggacaggggcttgagtggatgggatgg

SEQ ID NO: 4351 - DNA, 51 bp, Artificial Sequence
  Synthetic construct
atacagtgggtgcgacaggcccccggacaggggcttgagtggatgggatgg

SEQ ID NO: 4352 - DNA, 51 bp, Artificial Sequence
  Synthetic construct
atacattggatacgacaggcccctggacaaggccttgagtggatgggttgg

SEQ ID NO: 4353 - DNA, 51 bp, Artificial Sequence
  Synthetic construct
atacattggattcgacaggcccctggacaaggactggagtggatggggata

SEQ ID NO: 4354 - DNA, 51 bp, Artificial Sequence
  Synthetic construct
atacattggctgcgccaggcccccggacaaagccctgaatggatgggatgg

SEQ ID NO: 4355 - DNA, 51 bp, Artificial Sequence
  Synthetic construct
atacattgggtgcgactggcccctggacagagacttgagtggctggggtgg

SEQ ID NO: 4356 - DNA, 51 bp, Artificial Sequence
  Synthetic construct
atacattgggtgcgccaggcccccggacaaaggcttgagtgcatgggatgg

SEQ ID NO: 4357 - DNA, 51 bp, Artificial Sequence
  Synthetic construct
atacattgggtgcgccaggcccccggacaaaggcttgagtggatgggatgg

SEQ ID NO: 4358 - DNA, 51 bp, Artificial Sequence
  Synthetic construct
atacattgggtgcgccaggcccccggacaaaggcttgagtggatgggttgg

SEQ ID NO: 4359 - DNA, 51 bp, Artificial Sequence
  Synthetic construct
atacattgggtgcggcaggcccctggacaggggcttgagtggatgggatat

SEQ ID NO: 4360 - DNA, 51 bp, Artificial Sequence
  Synthetic construct
atagactggatacaacaggcccctggaaaagggcttgagtggatgggacgt

SEQ ID NO: 4361 - DNA, 51 bp, Artificial Sequence
  Synthetic construct
atatactgggtgcgacaggcccctggaaaaggacttgagtcgatgggacgt

SEQ ID NO: 4362 - DNA, 51 bp, Artificial Sequence
  Synthetic construct
atatattgggtgcgccaggcccccggacaaaggcttgagtggatgggatgg

SEQ ID NO: 4363 - DNA, 51 bp, Artificial Sequence
  Synthetic construct
atcaactgggtgcgacaggccactggacaagggcttgagtggatgggatac

SEQ ID NO: 4364 - DNA, 51 bp, Artificial Sequence
  Synthetic construct
atcaactgggtgcgacaggccactggacaagggcttgagtggatgggatgg

SEQ ID NO: 4365 - DNA, 51 bp, Artificial Sequence
  Synthetic construct
atcaactgggtgcgacaggccactggacaagggcttgagtgggtgggatgg

SEQ ID NO: 4366 - DNA, 51 bp, Artificial Sequence
  Synthetic construct
atcaactgggtgcgacaggccactggacaagggcttgtctggatgggatgg

SEQ ID NO: 4367 - DNA, 51 bp, Artificial Sequence
  Synthetic construct
atcaactgggtgcgacaggccagtggacaggggcttgagtggatgggatgg

SEQ ID NO: 4368 - DNA, 51 bp, Artificial Sequence
  Synthetic construct
atcaactgggtgcgacaggcccctggacaagaacttgagtggatgggaggc

SEQ ID NO: 4369 - DNA, 51 bp, Artificial Sequence
  Synthetic construct
atcaactgggtgcgacaggcccctggacaagggcttgagtggatgggaggg

SEQ ID NO: 4370 - DNA, 51 bp, Artificial Sequence
  Synthetic construct
atcaactgggtgcgacaggcccctggacaagggcttgagtggatgggatgg

SEQ ID NO: 4371 - DNA, 51 bp, Artificial Sequence
  Synthetic construct
atcaactgggtgcgacaggcccctggacaaggtcttgagtggatgggaggg

SEQ ID NO: 4372 - DNA, 51 bp, Artificial Sequence; identical to SEQ ID NO: 1784
  Synthetic construct

SEQ ID NO: 4373 - DNA, 51 bp, Artificial Sequence
  Synthetic construct
atcaattgggtgcgacaggcccctggacaaggacttgagtttatgggatgg

SEQ ID NO: 4374 - DNA, 51 bp, Artificial Sequence
  Synthetic construct
atcacctgggtgcgacaggcccctggacaagggcttgagtggatgggaaag

SEQ ID NO: 4375 - DNA, 51 bp, Artificial Sequence
  Synthetic construct
atcacctgggtgcgacaggcccctggacaagggcttgagtggatgggaggg

SEQ ID NO: 4376 - DNA, 51 bp, Artificial Sequence
  Synthetic construct
atcacctgggtgcgacaggcccctggacaagggcttgagtggatgggatgg

SEQ ID NO: 4377 - DNA, 51 bp, Artificial Sequence
  Synthetic construct
atcacctgggtgcgacaggcccctggacaagggcttgagtggatgggtggg

SEQ ID NO: 4378 - DNA, 51 bp, Artificial Sequence
  Synthetic construct
atcacctgggtgcgacaggcccctggacaggggcttgagtggatgggatgg

SEQ ID NO: 4379 - DNA, 51 bp, Artificial Sequence
  Synthetic construct
atcacctgggtgcgacaggcccctggacaggggcttgagtggctgggatgg

SEQ ID NO: 4380 - DNA, 51 bp, Artificial Sequence
  Synthetic construct
atcacgtgggtgcgacaggcccctggacaacggcctgagtggatggggggg

SEQ ID NO: 4381 - DNA, 51 bp, Artificial Sequence
  Synthetic construct
atcacttgggtccgacaggcacctggacagggactggaatggatgggagga

SEQ ID NO: 4382 - DNA, 51 bp, Artificial Sequence
  Synthetic construct
atcagctgggtgcgacaggcccccggccaagggcttgagtggatgggaggg

SEQ ID NO: 4383 - DNA, 51 bp, Artificial Sequence
  Synthetic construct
atcagctgggtgcgacaggcccctggacaaggccttgagtggatgggatgg

SEQ ID NO: 4384 - DNA, 51 bp, Artificial Sequence
  Synthetic construct
atcagctgggtgcgacaggcccctggacaagggctcgagtggatgggaggg

SEQ ID NO: 4385 - DNA, 51 bp, Artificial Sequence
  Synthetic construct
atcagctgggtgcgacaggcccctggacaagggcttcagtggatgggaggg

SEQ ID NO: 4386 - DNA, 51 bp, Artificial Sequence
  Synthetic construct
atcagctgggtgcgacaggcccctggacaagggcttgagtggatgggaggg

SEQ ID NO: 4387 - DNA, 51 bp, Artificial Sequence
  Synthetic construct
atcagctgggtgcgacaggcccctggacaagggcttgagtggatgggatgg

SEQ ID NO: 4388 - DNA, 51 bp, Artificial Sequence
  Synthetic construct
atcagctgggtgcgacaggcccctggacaagggcttgagtgggtgggatgg

SEQ ID NO: 4389 - DNA, 51 bp, Artificial Sequence
  Synthetic construct
atcagctgggtgcgacaggcccctggacaaggtcttgagtggatgggaggg

SEQ ID NO: 4390 - DNA, 51 bp, Artificial Sequence
  Synthetic construct
atcagctgggtgcgacaggcccctggacaaggtcttgagtggatgggatgg

SEQ ID NO: 4391 - DNA, 51 bp, Artificial Sequence
  Synthetic construct
atcagctgggtgcgacaggcccctggacaggggcttgagtggatgggaaac

SEQ ID NO: 4392 - DNA, 51 bp, Artificial Sequence
  Synthetic construct
atcagctgggtgcgacaggcccctggacaggggcttgagtggctgggaggg

SEQ ID NO: 4393 - DNA, 51 bp, Artificial Sequence
  Synthetic construct
atcagctgggtgcgacaggcccctgggcaagggcttgagtggatgggatgg

SEQ ID NO: 4394 - DNA, 51 bp, Artificial Sequence
  Synthetic construct
atcagctgggtgcgacaggtccctggacaagggcttgagtggatgggaggg

SEQ ID NO: 4395 - DNA, 51 bp, Artificial Sequence
  Synthetic construct
atcagctgggtgcgccaggcccccggacaagggcttgagtggatgggagga

SEQ ID NO: 4396 - DNA, 51 bp, Artificial Sequence
  Synthetic construct
atcagctgggtgcggcaggcccctggacaagggcttgagtggctgggctgg

SEQ ID NO: 4397 - DNA, 51 bp, Artificial Sequence
  Synthetic construct
atcagctgggtgcgtcaggcccctggacgagggcttgaatggatgggaggg

SEQ ID NO: 4398 - DNA, 51 bp, Artificial Sequence
  Synthetic construct
atcagttgggtgcgacaggcccctggacaagggcttgagtggatgggatgg

SEQ ID NO: 4399 - DNA, 51 bp, Artificial Sequence
  Synthetic construct
atcatctgggtgcggcaggcccctggacaaggccttgagtggatgggagga

SEQ ID NO: 4400 - DNA, 51 bp, Artificial Sequence
  Synthetic construct
atcatgtgggtccgacaggcccctggagaaggacttcagtggatgggatgg

SEQ ID NO: 4401 - DNA, 51 bp, Artificial Sequence
  Synthetic construct
atccactggattcaacaggcccctggaaaacgacctgagtggatggcacgt

SEQ ID NO: 4402 - DNA, 51 bp, Artificial Sequence
  Synthetic construct
atccactgggtccgccaggctcccggcagggggctggagtgggtggcagtt

SEQ ID NO: 4403 - DNA, 51 bp, Artificial Sequence
  Synthetic construct
atccactgggtgcaacaggcccctggaaaagggcttgagtggatgggacgc

SEQ ID NO: 4404 - DNA, 51 bp, Artificial Sequence
  Synthetic construct
atccactgggtgcgacaggcccctggacaagggcttgagtggatgggaggg

SEQ ID NO: 4405 - DNA, 51 bp, Artificial Sequence
  Synthetic construct
atccactgggtgcgacaggcccctggacaagggcttgagtggatgggagta

SEQ ID NO: 4406 - DNA, 51 bp, Artificial Sequence
  Synthetic construct
atccactgggtgcgacaggcccctggacaggggcttgagtggatgggatgg

SEQ ID NO: 4407 - DNA, 51 bp, Artificial Sequence
  Synthetic construct
atccactgggtgcgacaggcccctggactagggcttgagtggctgggatgg

SEQ ID NO: 4408 - DNA, 51 bp, Artificial Sequence
  Synthetic construct
atccactgggtgcgacaggctcctggaaaagggcttgagtggatgggaggt

SEQ ID NO: 4409 - DNA, 51 bp, Artificial Sequence
  Synthetic construct
atccactgggtgcgacaggctcctggaaaagggcttgagtggatggggggt

SEQ ID NO: 4410 - DNA, 51 bp, Artificial Sequence
  Synthetic construct
atccactgggtgcgacaggtcactggacaagggcttgagtggctgggatgc

SEQ ID NO: 4411 - DNA, 51 bp, Artificial Sequence
  Synthetic construct
atccactgggtgcggcaggcccctggacaggggcttgagtggatgggaata

SEQ ID NO: 4412 - DNA, 51 bp, Artificial Sequence
  Synthetic construct
atccattgggtgcgacgggcccctggacaaggtcttgagtggatggggtgg

SEQ ID NO: 4413 - DNA, 51 bp, Artificial Sequence
  Synthetic construct
atccattgggtgcgccaggcccccggagaaaggcttgagtggatgggatac

SEQ ID NO: 4414 - DNA, 51 bp, Artificial Sequence
  Synthetic construct
atcgcctgggtgcgccagatgcccgggaaaggcctggagtggatggggatc

SEQ ID NO: 4415 - DNA, 51 bp, Artificial Sequence
  Synthetic construct
atcgcctgggtgcgccagatgcccgggaaaggcctggagtggatgggggtc

SEQ ID NO: 4416 - DNA, 51 bp, Artificial Sequence
  Synthetic construct
atcgcctgggtgcgccaggtgtccgggaaaggcctggagtggatgggggtc

SEQ ID NO: 4417 - DNA, 51 bp, Artificial Sequence
  Synthetic construct
atcggctgggtacgccagatgcccgggaaaggcccggagtggatggggatc

SEQ ID NO: 4418 - DNA, 51 bp, Artificial Sequence
  Synthetic construct
atcggctgggtgcgccaagtgcccgggaaaggcctggagtggatggcgatc

SEQ ID NO: 4419 - DNA, 51 bp, Artificial Sequence
  Synthetic construct
atcggctgggtgcgccagaagcccgggaaaggcctggagtggatggggatc

SEQ ID NO: 4420 - DNA, 51 bp, Artificial Sequence
  Synthetic construct
atcggctgggtgcgccagaagcccggggagaccctggagttgatgggggtc

SEQ ID NO: 4421 - DNA, 51 bp, Artificial Sequence
  Synthetic construct
atcggctgggtgcgccagatgcccggaaaaggcctggagtggatgggtatc

SEQ ID NO: 4422 - DNA, 51 bp, Artificial Sequence
  Synthetic construct
atcggctgggtgcgccagatgcccgggaaaggcctggagtggataggaaat

SEQ ID NO: 4423 - DNA, 51 bp, Artificial Sequence
  Synthetic construct
atcggctgggtgcgccagatgcccgggaaaggcctggagtggatggcaatg

SEQ ID NO: 4424 - DNA, 51 bp, Artificial Sequence
  Synthetic construct
atcggctgggtgcgccagatgcccgggaaaggcctggagtggatggccatc

SEQ ID NO: 4425 - DNA, 51 bp, Artificial Sequence
  Synthetic construct
atcggctgggtgcgccagatgcccgggaaaggcctggagtggatgggaatc

SEQ ID NO: 4426 - DNA, 51 bp, Artificial Sequence
  Synthetic construct
atcggctgggtgcgccagatgcccgggaaaggcctggagtggatggggacc

SEQ ID NO: 4427 - DNA, 51 bp, Artificial Sequence
  Synthetic construct
atcggctgggtgcgccagatgcccgggaaaggcctggagtggatggggatc

SEQ ID NO: 4428 - DNA, 51 bp, Artificial Sequence
  Synthetic construct
atcggctgggtgcgccagatgcccggggaaggcctggagtggatggggatc

SEQ ID NO: 4429 - DNA, 51 bp, Artificial Sequence
  Synthetic construct
atcggttgggtgcgccagatgcccgggaaacgcctggagtggatgggagtc

SEQ ID NO: 4430 - DNA, 51 bp, Artificial Sequence
  Synthetic construct
atcgtctgggtgcgccagatgcccggaaaagggctggagtggatgggagtc

SEQ ID NO: 4431 - DNA, 51 bp, Artificial Sequence
  Synthetic construct
atcgtctgggtgcgccagatgcccgggaaaggcctggagtggatggggatc

SEQ ID NO: 4432 - DNA, 51 bp, Artificial Sequence
  Synthetic construct
atcgtctgggtgcgccagatgtccgggaaaggcctggagtggatgggagtc

SEQ ID NO: 4433 - DNA, 51 bp, Artificial Sequence
  Synthetic construct
atctactgggtgcgccgggcccccggacaaaggcttgagtggatgggatgg

SEQ ID NO: 4434 - DNA, 51 bp, Artificial Sequence
  Synthetic construct
atctcgtgggtgcgacaggccccgacacagggtcttgagtggatgggaggg

SEQ ID NO: 4435 - DNA, 51 bp, Artificial Sequence
  Synthetic construct
atgaactgggtccgccaagctccagggaagggcctggagtggatttcatac

SEQ ID NO: 4436 - DNA, 51 bp, Artificial Sequence
  Synthetic construct
atgaactgggtccgccagactccagggaaggggctggagtgggtctcaggt

SEQ ID NO: 4437 - DNA, 51 bp, Artificial Sequence
  Synthetic construct
atgaactgggtccgccagactccagggatgggactggagtgggtttcatat

SEQ ID NO: 4438 - DNA, 51 bp, Artificial Sequence
  Synthetic construct
atgaactgggtccgccaggcgccagggaaggggctggagtgggttggccgt

SEQ ID NO: 4439 - DNA, 51 bp, Artificial Sequence
  Synthetic construct
atgaactgggtccgccaggctccagggaagggactggagtgggtctcatac

SEQ ID NO: 4440 - DNA, 51 bp, Artificial Sequence
  Synthetic construct
atgaactgggtccgccaggctccagggaagggactggagtgggtctcatcc

SEQ ID NO: 4441 - DNA, 51 bp, Artificial Sequence
  Synthetic construct
atgaactgggtccgccaggctccagggaaggggctagagtgggtctcaggt

SEQ ID NO: 4442 - DNA, 51 bp, Artificial Sequence
  Synthetic construct
atgaactgggtccgccaggctccagggaaggggctggagtggatttcatac

SEQ ID NO: 4443 - DNA, 51 bp, Artificial Sequence
  Synthetic construct
atgaactgggtccgccaggctccagggaaggggctggagtgggtctcaatt

SEQ ID NO: 4444 - DNA, 51 bp, Artificial Sequence
  Synthetic construct
atgaactgggtccgccaggctccagggaaggggctggagtgggtctcaggt

SEQ ID NO: 4445 - DNA, 51 bp, Artificial Sequence
  Synthetic construct
atgaactgggtccgccaggctccagggaaggggctggagtgggtctcatat

SEQ ID NO: 4446 - DNA, 51 bp, Artificial Sequence
  Synthetic construct
atgaactgggtccgccaggctccagggaaggggctggagtgggtctcatca

SEQ ID NO: 4447 - DNA, 51 bp, Artificial Sequence
  Synthetic construct
atgaactgggtccgccaggctccagggaaggggctggagtgggtctcatcc

SEQ ID NO: 4448 - DNA, 51 bp, Artificial Sequence
  Synthetic construct
atgaactgggtccgccaggctccagggaaggggctggagtgggtctcattc

SEQ ID NO: 4449 - DNA, 51 bp, Artificial Sequence
  Synthetic construct
atgaactgggtccgccaggctccagggaaggggctggagtgggtttcatac

SEQ ID NO: 4450 - DNA, 51 bp, Artificial Sequence
  Synthetic construct
atgaactgggtccgccaggctccagggaggggcctggagtgggtcgcaacc

SEQ ID NO: 4451 - DNA, 51 bp, Artificial Sequence
  Synthetic construct
atgaactgggtccgccaggctccagggagggggctggagtgggtctcacat

SEQ ID NO: 4452 - DNA, 51 bp, Artificial Sequence
  Synthetic construct
atgaactgggtccgccaggctccagggatggggctggagtgggtttcatac

SEQ ID NO: 4453 - DNA, 51 bp, Artificial Sequence
  Synthetic construct
atgaactgggtccgccaggctccaggggaggggctggagtggattgcatac

SEQ ID NO: 4454 - DNA, 51 bp, Artificial Sequence
  Synthetic construct
atgaactgggtccgccaggctccgggggaggggctggagtgggtttcattc

SEQ ID NO: 4455 - DNA, 51 bp, Artificial Sequence
  Synthetic construct
atgaactgggtccgccaggctgcagggaaggggctggagtgggtttcatat

SEQ ID NO: 4456 - DNA, 51 bp, Artificial Sequence
  Synthetic construct
atgaactgggtccgccaggttccagggaaggggctggagtgggtctcatcc

SEQ ID NO: 4457 - DNA, 51 bp, Artificial Sequence
  Synthetic construct
atgaactgggtccgccggactccagagaagggcctggagtgggtcgcatcc

SEQ ID NO: 4458 - DNA, 51 bp, Artificial Sequence
  Synthetic construct
atgaactgggtccgctgggctccagggaaggggctggagtgggtcgcatcc

SEQ ID NO: 4459 - DNA, 51 bp, Artificial Sequence
  Synthetic construct
atgaactgggtgcgacaggcccctggacaagggcttgagtggatgggatgg

SEQ ID NO: 4460 - DNA, 51 bp, Artificial Sequence
  Synthetic construct
atgaagtggatccgccaggctccagggaaggggctggagtgggtttcatac

SEQ ID NO: 4461 - DNA, 51 bp, Artificial Sequence
  Synthetic construct
atgaattggattcgccaggctccagggaaggggctggagtggctttcatat

SEQ ID NO: 4462 - DNA, 51 bp, Artificial Sequence
  Synthetic construct
atgaattgggtccgccagactccagggaaggggctggagtgggtctcgtcc

SEQ ID NO: 4463 - DNA, 51 bp, Artificial Sequence
  Synthetic construct
atgaattgggtccgccaggctccagggaagggactggagtgggtcgcttcc

SEQ ID NO: 4464 - DNA, 51 bp, Artificial Sequence
  Synthetic construct
atgaattgggtccgccaggctccagggaaggggctggaatgggtctcatac

SEQ ID NO: 4465 - DNA, 51 bp, Artificial Sequence
  Synthetic construct
atgaattgggtccgccaggctccagggaggggactggagtggatttcatac

SEQ ID NO: 4466 - DNA, 51 bp, Artificial Sequence
  Synthetic construct
atgaattgggtccgccaggctccagggagggggctgcagtggcttgcattc

SEQ ID NO: 4467 - DNA, 51 bp, Artificial Sequence
  Synthetic construct
atgaattgggtccgccaggctccagggcaggggctggactgggtcggccgt

SEQ ID NO: 4468 - DNA, 51 bp, Artificial Sequence
  Synthetic construct
atgaattgggtccgccagtctccagggaaggggctggagtgggtttcatac

SEQ ID NO: 4469 - DNA, 51 bp, Artificial Sequence
  Synthetic construct
atgaattgggtccgtcaggctccagggaaggggctagagtgggtcgcatcc

SEQ ID NO: 4470 - DNA, 51 bp, Artificial Sequence
  Synthetic construct
atgaattgggtgcgacaggcccctggacaagggcttgagtggatgggatgg

SEQ ID NO: 4471 - DNA, 51 bp, Artificial Sequence
  Synthetic construct
atgaattgggtgcgacaggtccctggacaagggcttgagtggatgggatgg

SEQ ID NO: 4472 - DNA, 51 bp, Artificial Sequence
  Synthetic construct
atgaattgggtgcggcaggcccctgggcaagggcttgagtggatgggatgg

SEQ ID NO: 4473 - DNA, 51 bp, Artificial Sequence
  Synthetic construct
atgacctgggtccgccaagctccagggaagggcctggagtgggtcgctggt

SEQ ID NO: 4474 - DNA, 51 bp, Artificial Sequence
  Synthetic construct
atgacctgggtccgccaagttccagggaaggggctgcagtgggtcgctggc

SEQ ID NO: 4475 - DNA, 51 bp, Artificial Sequence
  Synthetic construct
atgacctgggtccgccacgctgcagggaaggggctgcagtgggtctcagtt

SEQ ID NO: 4476 - DNA, 51 bp, Artificial Sequence
  Synthetic construct
atgacctgggtccgccaggctccaggaaaggggctggagtgggtctcaact

SEQ ID NO: 4477 - DNA, 51 bp, Artificial Sequence
  Synthetic construct
atgacctgggtccgccaggctccagggaagggactggagtgggtaggtttc

SEQ ID NO: 4478 - DNA, 51 bp, Artificial Sequence
  Synthetic construct
atgacctgggtccgccaggctccagggaaggggccggagtgggtctcaagt

SEQ ID NO: 4479 - DNA, 51 bp, Artificial Sequence
  Synthetic construct
atgacctgggtccgccaggctccagggaaggggctggaatgggtctcagtt

SEQ ID NO: 4480 - DNA, 51 bp, Artificial Sequence
  Synthetic construct
atgacctgggtccgccaggctccagggaaggggctggagtggatggcctgc

SEQ ID NO: 4481 - DNA, 51 bp, Artificial Sequence
  Synthetic construct
atgacctgggtccgccaggctccagggaaggggctggagtgggtctcaact

SEQ ID NO: 4482 - DNA, 51 bp, Artificial Sequence
  Synthetic construct
atgacctgggtccgccaggctccagggaaggggctggagtgggtctcaagc

SEQ ID NO: 4483 - DNA, 51 bp, Artificial Sequence
  Synthetic construct
atgacctgggtccgccaggctccagggaaggggctggagtgggtctcaagt

SEQ ID NO: 4484 - DNA, 51 bp, Artificial Sequence
  Synthetic construct
atgacctgggtccgccaggctccagggaaggggctggagtgggtctcagct

SEQ ID NO: 4485 - DNA, 51 bp, Artificial Sequence
  Synthetic construct
atgacctgggtccgccaggctccagggaaggggctggagtgggtggccaac

SEQ ID NO: 4486 - DNA, 51 bp, Artificial Sequence
  Synthetic construct
atgacctgggtccgccaggctccagggaaggggctggagtgggtttcacac

SEQ ID NO: 4487 - DNA, 51 bp, Artificial Sequence
  Synthetic construct
atgacctgggtccgccaggctcccgggaaggggctggagtgggtaggtctc

SEQ ID NO: 4488 - DNA, 51 bp, Artificial Sequence
  Synthetic construct
atgacctgggtccgccaggttccagggaaggggctggagtgggtctcagtt

SEQ ID NO: 4489 - DNA, 51 bp, Artificial Sequence
  Synthetic construct
atgacgtgggtccgccaggctccagggaaggggctggagctgctgggcaac

SEQ ID NO: 4490 - DNA, 51 bp, Artificial Sequence
  Synthetic construct
atgacgtgggtccgccaggctcccgggaaggggctggagtgggtaggtctc

SEQ ID NO: 4491 - DNA, 51 bp, Artificial Sequence
  Synthetic construct
atgacgtgggtgcgccagactcaagggaagaggctggaatgggtggccagc

SEQ ID NO: 4492 - DNA, 51 bp, Artificial Sequence
  Synthetic construct
atgacttggatccgccaggctccagggaagggcctggagtgggttgcgtac

SEQ ID NO: 4493 - DNA, 51 bp, Artificial Sequence
  Synthetic construct
atgacttggatccgccaggctccagggaaggggctggagtggatttcatat

SEQ ID NO: 4494 - DNA, 51 bp, Artificial Sequence
  Synthetic construct
atgacttgggtccgccaggcgccagggaaggggctggagtgggtcgcaagt

SEQ ID NO: 4495 - DNA, 51 bp, Artificial Sequence
  Synthetic construct
atgacttgggtccgcgagactccagggaaggggctggagtgggtctcaggt

SEQ ID NO: 4496 - DNA, 51 bp, Artificial Sequence
  Synthetic construct
atgagctggatccgccaggctccagggaaggggctggagtgggtctcatac

SEQ ID NO: 4497 - DNA, 51 bp, Artificial Sequence
  Synthetic construct
atgagctggatccgccaggctccagggaaggggctggagtgggtttcatac

SEQ ID NO: 4498 - DNA, 51 bp, Artificial Sequence
  Synthetic construct
atgagctggatccgccaggctccagggaaggggttggagtggctttcatat

SEQ ID NO: 4499 - DNA, 51 bp, Artificial Sequence
  Synthetic construct
atgagctggatccgccaggctccggggaaggggctggagtgggtgtcatac

SEQ ID NO: 4500 - DNA, 51 bp, Artificial Sequence
  Synthetic construct
atgagctggattcgccaggctccagggaaggggctggagtgggtttcatac

SEQ ID NO: 4501 - DNA, 51 bp, Artificial Sequence
  Synthetic construct
atgagctgggtccgccaagttccagggaaggggctggagtgggtctctggt

SEQ ID NO: 4502 - DNA, 51 bp, Artificial Sequence
  Synthetic construct
atgagctgggtccgccagactccaggcaagggactggagtgggtcgcaact

SEQ ID NO: 4503 - DNA, 51 bp, Artificial Sequence
  Synthetic construct
atgagctgggtccgccaggctccagggaaggggctcgagtgggtctcaggt

SEQ ID NO: 4504 - DNA, 51 bp, Artificial Sequence
  Synthetic construct
atgagctgggtccgccaggctccagggaaggggctggaatggatctcaggt

SEQ ID NO: 4505 - DNA, 51 bp, Artificial Sequence
  Synthetic construct
atgagctgggtccgccaggctccagggaaggggctggagtggatctcaggt

SEQ ID NO: 4506 - DNA, 51 bp, Artificial Sequence
  Synthetic construct
atgagctgggtccgccaggctccagggaaggggctggagtggattggtcgt

SEQ ID NO: 4507 - DNA, 51 bp, Artificial Sequence
  Synthetic construct
atgagctgggtccgccaggctccagggaaggggctggagtgggtaggttta

SEQ ID NO: 4508 - DNA, 51 bp, Artificial Sequence
  Synthetic construct
atgagctgggtccgccaggctccagggaaggggctggagtgggtaggtttc

SEQ ID NO: 4509 - DNA, 51 bp, Artificial Sequence
  Synthetic construct
atgagctgggtccgccaggctccagggaaggggctggagtgggtcgcagtt

SEQ ID NO: 4510 - DNA, 51 bp, Artificial Sequence
  Synthetic construct
atgagctgggtccgccaggctccagggaaggggctggagtgggtctcaact

SEQ ID NO: 4511 - DNA, 51 bp, Artificial Sequence
  Synthetic construct
atgagctgggtccgccaggctccagggaaggggctggagtgggtctcaagt

SEQ ID NO: 4512 - DNA, 51 bp, Artificial Sequence
  Synthetic construct
atgagctgggtccgccaggctccagggaaggggctggagtgggtctcacat

SEQ ID NO: 4513 - DNA, 51 bp, Artificial Sequence
  Synthetic construct
atgagctgggtccgccaggctccagggaaggggctggagtgggtctcagcc

SEQ ID NO: 4514 - DNA, 51 bp, Artificial Sequence
  Synthetic construct
atgagctgggtccgccaggctccagggaaggggctggagtgggtctcagct

SEQ ID NO: 4515 - DNA, 51 bp, Artificial Sequence
  Synthetic construct
atgagctgggtccgccaggctccagggaaggggctggagtgggtctcaggt

SEQ ID NO: 4516 - DNA, 51 bp, Artificial Sequence
  Synthetic construct
atgagctgggtccgccaggctccagggaaggggctggagtgggtctcagtt

SEQ ID NO: 4517 - DNA, 51 bp, Artificial Sequence; identical to SEQ ID NO: 1783
  Synthetic construct

SEQ ID NO: 4518 - DNA, 51 bp, Artificial Sequence
  Synthetic construct
atgagctgggtccgccaggctccagggaaggggctggagtgggtggccaac

SEQ ID NO: 4519 - DNA, 51 bp, Artificial Sequence
  Synthetic construct
atgagctgggtccgccaggctccagggaaggggctggagtgggtggccttc

SEQ ID NO: 4520 - DNA, 51 bp, Artificial Sequence
  Synthetic construct
atgagctgggtccgccaggctccagggaaggggctggagtgggttggccgt

SEQ ID NO: 4521 - DNA, 51 bp, Artificial Sequence
  Synthetic construct
atgagctgggtccgccaggctccagggaagggtctggagtgggtaggtctc

SEQ ID NO: 4522 - DNA, 51 bp, Artificial Sequence
  Synthetic construct
atgagctgggtccgccaggctccagggacggggctggagtgggtctcagct

SEQ ID NO: 4523 - DNA, 51 bp, Artificial Sequence
  Synthetic construct
atgagctgggtccgccaggctccaggtaaggggctggagtgggtggccaac

SEQ ID NO: 4524 - DNA, 51 bp, Artificial Sequence
  Synthetic construct
atgagctgggtccgcctgactccagggaagtggctggagtgggtggccacc

SEQ ID NO: 4525 - DNA, 51 bp, Artificial Sequence
  Synthetic construct
atgagctgggtccgcctggctccagggaagggcctggagtgggtctcagtt

SEQ ID NO: 4526 - DNA, 51 bp, Artificial Sequence
  Synthetic construct
atgagctgggtccggcaggctccagggaagggactggagtgggtggccaac

SEQ ID NO: 4527 - DNA, 51 bp, Artificial Sequence
  Synthetic construct
atgagttggatccgccaggctccagggaaggggctggagtgggtttcagat

SEQ ID NO: 4528 - DNA, 51 bp, Artificial Sequence
  Synthetic construct
atgagttgggtccgccaagttccagggagggggctggagtgggtctctggc

SEQ ID NO: 4529 - DNA, 51 bp, Artificial Sequence
  Synthetic construct
atgagttgggtccgccaggctccaggcaaggggctggagtgggtggccaat

SEQ ID NO: 4530 - DNA, 51 bp, Artificial Sequence
  Synthetic construct
atgagttgggtccgccaggctccagggaaggggctagagtgggtttcatat

SEQ ID NO: 4531 - DNA, 51 bp, Artificial Sequence
  Synthetic construct
atgagttgggtccgccaggctccagggaaggggctggagtgggtaggtttc

SEQ ID NO: 4532 - DNA, 51 bp, Artificial Sequence
  Synthetic construct
atgagttgggtccgccaggctccagggaaggggctggagtgggtctcaacg

SEQ ID NO: 4533 - DNA, 51 bp, Artificial Sequence
  Synthetic construct
atgagttgggtccgccaggctccagggaaggggctggagtgggtctcagct

SEQ ID NO: 4534 - DNA, 51 bp, Artificial Sequence
  Synthetic construct
atgagttgggtccgccaggctccagggaaggggctggagtgggtggccaat

SEQ ID NO: 4535 - DNA, 51 bp, Artificial Sequence
  Synthetic construct
atgagttgggtccgccaggctccagggaaggggctggagtgggttggccgt

SEQ ID NO: 4536 - DNA, 51 bp, Artificial Sequence
  Synthetic construct
atgagttgggtccgccaggctccggggaaggggctggagtgggtggccaac

SEQ ID NO: 4537 - DNA, 51 bp, Artificial Sequence
  Synthetic construct
atgagttgggtccgccagtctccaggaaaggggctggagtgggtggccaac

SEQ ID NO: 4538 - DNA, 51 bp, Artificial Sequence
  Synthetic construct
atgagttgggtccgccagtctccagggagggggctggagtgggttggccga

SEQ ID NO: 4539 - DNA, 51 bp, Artificial Sequence
  Synthetic construct
atgagttgggtccggcaggctccaggaaagggactagagtgggtcgcatat

SEQ ID NO: 4540 - DNA, 51 bp, Artificial Sequence
  Synthetic construct
atgatatgggtgcgacaggcccctggagaagggcttgagtggatgggaggg

SEQ ID NO: 4541 - DNA, 51 bp, Artificial Sequence
  Synthetic construct
atgatctggatccgccaggctccagggaaggggctggagtggatttcattc

SEQ ID NO: 4542 - DNA, 51 bp, Artificial Sequence
  Synthetic construct
atgatctgggtccgccagcctccagggaaggggctggagtgggtctcatct

SEQ ID NO: 4543 - DNA, 51 bp, Artificial Sequence
  Synthetic construct
atgatctgggtccgccaggctccagggaaggggctggagtgggtctcatct

SEQ ID NO: 4544 - DNA, 51 bp, Artificial Sequence
  Synthetic construct
atgatctgggtccgccaggctccagggaaggggctggagtgggttgcatat

SEQ ID NO: 4545 - DNA, 51 bp, Artificial Sequence
  Synthetic construct
atgcactggattcaacaggcccctggaaaagggcttgagtggttgggacgt

SEQ ID NO: 4546 - DNA, 51 bp, Artificial Sequence
  Synthetic construct
atgcactgggcccgccaggctccagacaagggcctggagtgggtggcgatt

SEQ ID NO: 4547 - DNA, 51 bp, Artificial Sequence
  Synthetic construct
atgcactgggtccgccaagctccagggaagggactggtgtgggtctcacgt

SEQ ID NO: 4548 - DNA, 51 bp, Artificial Sequence
  Synthetic construct
atgcactgggtccgccactctccagggaagggactggagtgggtctcatcc

SEQ ID NO: 4549 - DNA, 51 bp, Artificial Sequence
  Synthetic construct
atgcactgggtccgccagcctccagggaagggactgcaatttgtttcaagt

SEQ ID NO: 4550 - DNA, 51 bp, Artificial Sequence
  Synthetic construct
atgcactgggtccgccaggcgccaggcaaggggctggagtgggtggcaggt

SEQ ID NO: 4551 - DNA, 51 bp, Artificial Sequence
  Synthetic construct
atgcactgggtccgccaggctccaggcaagggactggagtgggtggcagtt

SEQ ID NO: 4552 - DNA, 51 bp, Artificial Sequence
  Synthetic construct
atgcactgggtccgccaggctccaggcaagggcctggagtggctggcactt

SEQ ID NO: 4553 - DNA, 51 bp, Artificial Sequence
  Synthetic construct
atgcactgggtccgccaggctccaggcaaggggctgcaatggctgggagtt

SEQ ID NO: 4554 - DNA, 51 bp, Artificial Sequence
  Synthetic construct
atgcactgggtccgccaggctccaggcaaggggctggaatggctggcagtt

SEQ ID NO: 4555 - DNA, 51 bp, Artificial Sequence
  Synthetic construct
atgcactgggtccgccaggctccaggcaaggggctggaatgggtggcagtt

SEQ ID NO: 4556 - DNA, 51 bp, Artificial Sequence
  Synthetic construct
atgcactgggtccgccaggctccaggcaaggggctggagtggctggcactt

SEQ ID NO: 4557 - DNA, 51 bp, Artificial Sequence
  Synthetic construct
atgcactgggtccgccaggctccaggcaaggggctggagtggctggcagtc

SEQ ID NO: 4558 - DNA, 51 bp, Artificial Sequence
  Synthetic construct
atgcactgggtccgccaggctccaggcaaggggctggagtggctggcagtt

SEQ ID NO: 4559 - DNA, 51 bp, Artificial Sequence
  Synthetic construct
atgcactgggtccgccaggctccaggcaaggggctggagtgggtgacagtt

SEQ ID NO: 4560 - DNA, 51 bp, Artificial Sequence
  Synthetic construct
atgcactgggtccgccaggctccaggcaaggggctggagtgggtgacattt

SEQ ID NO: 4561 - DNA, 51 bp, Artificial Sequence
  Synthetic construct
atgcactgggtccgccaggctccaggcaaggggctggagtgggtggcaatt

SEQ ID NO: 4562 - DNA, 51 bp, Artificial Sequence
  Synthetic construct
atgcactgggtccgccaggctccaggcaaggggctggagtgggtggcacaa

SEQ ID NO: 4563 - DNA, 51 bp, Artificial Sequence
  Synthetic construct
atgcactgggtccgccaggctccaggcaaggggctggagtgggtggcagta

SEQ ID NO: 4564 - DNA, 51 bp, Artificial Sequence
  Synthetic construct
atgcactgggtccgccaggctccaggcaaggggctggagtgggtggcagtt

SEQ ID NO: 4565 - DNA, 51 bp, Artificial Sequence
  Synthetic construct
atgcactgggtccgccaggctccaggcaaggggctggagtgggtggcatat

SEQ ID NO: 4566 - DNA, 51 bp, Artificial Sequence
  Synthetic construct
atgcactgggtccgccaggctccaggcaaggggctggagtgggtggcattt

SEQ ID NO: 4567 - DNA, 51 bp, Artificial Sequence
  Synthetic construct
atgcactgggtccgccaggctccaggcaaggggctggagtgggtggccgtt

SEQ ID NO: 4568 - DNA, 51 bp, Artificial Sequence
  Synthetic construct
atgcactgggtccgccaggctccaggcaaggggctggagtgggtggctttt

SEQ ID NO: 4569 - DNA, 51 bp, Artificial Sequence
  Synthetic construct
atgcactgggtccgccaggctccaggcaaggggctggagtgggtgggagtt

SEQ ID NO: 4570 - DNA, 51 bp, Artificial Sequence
  Synthetic construct
atgcactgggtccgccaggctccaggcaaggggctggagtgggtgtcaatt

SEQ ID NO: 4571 - DNA, 51 bp, Artificial Sequence
  Synthetic construct
atgcactgggtccgccaggctccaggcaaggggctggagtgggtgtcatgt

SEQ ID NO: 4572 - DNA, 51 bp, Artificial Sequence
  Synthetic construct
atgcactgggtccgccaggctccaggcaaggggctggagtggttatcactt

SEQ ID NO: 4573 - DNA, 51 bp, Artificial Sequence
  Synthetic construct
atgcactgggtccgccaggctccaggcaggggtctggagtgggtggcaggt

SEQ ID NO: 4574 - DNA, 51 bp, Artificial Sequence
  Synthetic construct
atgcactgggtccgccaggctccaggcgaggggctggagtgggtggcgttt

SEQ ID NO: 4575 - DNA, 51 bp, Artificial Sequence
  Synthetic construct
atgcactgggtccgccaggcttccgggaaagggctggagtgggttggccgt

SEQ ID NO: 4576 - DNA, 51 bp, Artificial Sequence
  Synthetic construct
atgcactgggtccggcaaactccagggaagggcctggagtgggtcgcaggt

SEQ ID NO: 4577 - DNA, 51 bp, Artificial Sequence
  Synthetic construct
atgcactgggtccggcaagctccagggaaaggcctggagtgggtctcaggt

SEQ ID NO: 4578 - DNA, 51 bp, Artificial Sequence
  Synthetic construct
atgcactgggtccggcaagctccagggaagggcctggagtgggtctcaggc

SEQ ID NO: 4579 - DNA, 51 bp, Artificial Sequence
  Synthetic construct
atgcactgggtccggcaagctccagggaagggcctggagtgggtctcaggt

SEQ ID NO: 4580 - DNA, 51 bp, Artificial Sequence
  Synthetic construct
atgcactgggtccggcaagttccagggaagggcctggagtgggtctcaggt

SEQ ID NO: 4581 - DNA, 51 bp, Artificial Sequence
  Synthetic construct
atgcactgggtccgtcaggctccggggaaaggtctggaatgggtctctctt

SEQ ID NO: 4582 - DNA, 51 bp, Artificial Sequence
  Synthetic construct
atgcactgggtccgtcaggctccggggaagggtctggagtgggtctctctt

SEQ ID NO: 4583 - DNA, 51 bp, Artificial Sequence
  Synthetic construct
atgcactgggtccgtcgggtgccggggaagggtctggagtgggtctctgcc

SEQ ID NO: 4584 - DNA, 51 bp, Artificial Sequence
  Synthetic construct
atgcactgggtgcaacaggcccctggaaaagggcttgagtggatgggacgt

SEQ ID NO: 4585 - DNA, 51 bp, Artificial Sequence
  Synthetic construct
atgcactgggtgcaacgggccccaggaagagggtttgagtggatgggacgt

SEQ ID NO: 4586 - DNA, 51 bp, Artificial Sequence
  Synthetic construct
atgcactgggtgcatcaggcccctggcaaaggccttgagtggatgggacgt

SEQ ID NO: 4587 - DNA, 51 bp, Artificial Sequence
  Synthetic construct
atgcactgggtgcgacaggcccctggacaaggacttgaatggatgggaata

SEQ ID NO: 4588 - DNA, 51 bp, Artificial Sequence
  Synthetic construct
atgcactgggtgcgacaggcccctggacaaggccttgagtggatgggagtg

SEQ ID NO: 4589 - DNA, 51 bp, Artificial Sequence
  Synthetic construct
atgcactgggtgcgacaggcccctggacaagggcctgagtgggtggctatg

SEQ ID NO: 4590 - DNA, 51 bp, Artificial Sequence
  Synthetic construct
atgcactgggtgcgacaggcccctggacaagggcttgagtggatgggaata

SEQ ID NO: 4591 - DNA, 51 bp, Artificial Sequence
  Synthetic construct
atgcactgggtgcgacaggcccctggacaagggcttgagtggatgggagta

SEQ ID NO: 4592 - DNA, 51 bp, Artificial Sequence
  Synthetic construct
atgcactgggtgcgacaggcccctggacaagggcttgagtggatgggatgg

SEQ ID NO: 4593 - DNA, 51 bp, Artificial Sequence
  Synthetic construct
atgcactgggtgcgacaggcccctggacaagggcttgagtggatggggaca

SEQ ID NO: 4594 - DNA, 51 bp, Artificial Sequence
  Synthetic construct
atgcactgggtgcgacaggcccctggccaggggcttgagtggatgggatta

SEQ ID NO: 4595 - DNA, 51 bp, Artificial Sequence
  Synthetic construct
atgcactgggtgcgacaggctcctggaaaagggcttgagtggatgggaggt

SEQ ID NO: 4596 - DNA, 51 bp, Artificial Sequence
  Synthetic construct
atgcactgggtgcgccaggcccccggacaaaggcttgagtggatgggacgc

SEQ ID NO: 4597 - DNA, 51 bp, Artificial Sequence
  Synthetic construct
atgcagtgggtgcgacaggctcgtggacaacgccttgagtggataggatgg

SEQ ID NO: 4598 - DNA, 51 bp, Artificial Sequence
  Synthetic construct
atgcattgggtccgccaggccccaggcaaagggctggagtgggtggctgtc

SEQ ID NO: 4599 - DNA, 51 bp, Artificial Sequence
  Synthetic construct
atgcattgggtgcgccaggcccccggacaaaggcttgagtggatgggatgg

SEQ ID NO: 4600 - DNA, 51 bp, Artificial Sequence
  Synthetic construct
atgcattgggtgcgccaggcccccggacaagggcttgagtggatgggatgg

SEQ ID NO: 4601 - DNA, 51 bp, Artificial Sequence
  Synthetic construct
atgcattgggtgcgccaggcccccggacagaggcttgagtggatgggatgg

SEQ ID NO: 4602 - DNA, 51 bp, Artificial Sequence
  Synthetic construct
atgcattgggtgcgccaggcccctggagaagggcttgagtggatgggacgt

SEQ ID NO: 4603 - DNA, 51 bp, Artificial Sequence
  Synthetic construct
atggactgggtccgccaggctccagggaaggggctggagtgggtctcatcc

SEQ ID NO: 4604 - DNA, 51 bp, Artificial Sequence
  Synthetic construct
atggactgggtccgccaggctccagggatgggactggagtgggttggccgt

SEQ ID NO: 4605 - DNA, 51 bp, Artificial Sequence
  Synthetic construct
atggattgggtccgccaggcgccaggcaagggtctggagtgggtggcaggt

SEQ ID NO: 4606 - DNA, 51 bp, Artificial Sequence
  Synthetic construct
atggcctgggtccgccaggctccagggaaggggctgttgtggatcggtttc

SEQ ID NO: 4607 - DNA, 51 bp, Artificial Sequence
  Synthetic construct
atggcctgggtccgccagtctccagaaaaggggctggattgggtctcactt

SEQ ID NO: 4608 - DNA, 51 bp, Artificial Sequence
  Synthetic construct
atggcgtgggtccgcaaggcgccagggaaggggctggagtgggtctcctcc

SEQ ID NO: 4609 - DNA, 51 bp, Artificial Sequence
  Synthetic construct
atggcttggatccgccagactccagggcagggactggagtggattgcatat

SEQ ID NO: 4610 - DNA, 51 bp, Artificial Sequence
  Synthetic construct
atgggctggatccgccaggcaccagggaaggggctggagtggatttcatat

SEQ ID NO: 4611 - DNA, 51 bp, Artificial Sequence
  Synthetic construct
atgggctgggtccgccaggctccagggaaggggctggagtgggtggccaac

SEQ ID NO: 4612 - DNA, 51 bp, Artificial Sequence
  Synthetic construct
atgggctgggtccgccaggctccagggaaggggcttgagtgggtcgcaggc

SEQ ID NO: 4613 - DNA, 51 bp, Artificial Sequence
  Synthetic construct
atggtctgggtccgccaggctccagggaaggggctggagtggatttcatac

SEQ ID NO: 4614 - DNA, 51 bp, Artificial Sequence
  Synthetic construct
atggtctgggtccgccaggctccagggaaggggctggagtgggtctcgtcc

SEQ ID NO: 4615 - DNA, 51 bp, Artificial Sequence
  Synthetic construct
atgtactgggtccgccaagctccagggaaggggctggtgtgggtctcacgt

SEQ ID NO: 4616 - DNA, 51 bp, Artificial Sequence; identical to SEQ ID NO: 1782
  Synthetic construct

SEQ ID NO: 4617 - DNA, 51 bp, Artificial Sequence
  Synthetic construct
atgtcctggttccgccaggctccagggaaggggccggagtgggtctcagtc

SEQ ID NO: 4618 - DNA, 51 bp, Artificial Sequence
  Synthetic construct
atgtcgtgggtccgccagtctccagggaagggactggaatgggtctcatcc

SEQ ID NO: 4619 - DNA, 51 bp, Artificial Sequence
  Synthetic construct
atgttctgggtccgccaggctccagggaaggggctggagtgggtctctggt

SEQ ID NO: 4620 - DNA, 51 bp, Artificial Sequence
  Synthetic construct
attaattgggtgcgacaggcccctggacaaggtcttgagtgggtgggaggg

SEQ ID NO: 4621 - DNA, 51 bp, Artificial Sequence
  Synthetic construct
attaattgggtgcgacaggcctctggtcaagggcccgagtggatgggatgg

SEQ ID NO: 4622 - DNA, 51 bp, Artificial Sequence
  Synthetic construct
attacctgggtgcgacaggcccctggacaaggtcttgagtggctgggaggg

SEQ ID NO: 4623 - DNA, 51 bp, Artificial Sequence
  Synthetic construct
attcactggatgcgacaaagtcgtggactacgccttgagtggatgggatgg

SEQ ID NO: 4624 - DNA, 51 bp, Artificial Sequence
  Synthetic construct
attcactgggtgcaacaggcccctggaaaagggcttgagtggttgggtcgt

SEQ ID NO: 4625 - DNA, 51 bp, Artificial Sequence
  Synthetic construct
attcactgggtgcgacaggcccctggacaagggcttgagtggatgggatgg

SEQ ID NO: 4626 - DNA, 51 bp, Artificial Sequence
  Synthetic construct
attcactgggtggtacaggcccctggaaaagggcttgagtggatgggacgt

SEQ ID NO: 4627 - DNA, 51 bp, Artificial Sequence
  Synthetic construct
attcactgggttcgacaggcccctggacaagggcttgagtggatgggccgg

SEQ ID NO: 4628 - DNA, 51 bp, Artificial Sequence
  Synthetic construct
attcagtgggtgcgacaggcccctggacaagggcttgagtggatgggatgg

SEQ ID NO: 4629 - DNA, 51 bp, Artificial Sequence
  Synthetic construct
attcattggctgcgccaggcccccgggcaaaggcctgagtggttgggatac

SEQ ID NO: 4630 - DNA, 51 bp, Artificial Sequence
  Synthetic construct
attcattgggtccgccaggctccaggcaaggggctggagtgggtctcggtt

SEQ ID NO: 4631 - DNA, 51 bp, Artificial Sequence; identical to SEQ ID NO: 1785
  Synthetic construct

SEQ ID NO: 4632 - DNA, 51 bp, Artificial Sequence
  Synthetic construct
atttactgggtgcaacaggcccctggaaaaggccctgagtggatgggacgt

SEQ ID NO: 4633 - DNA, 51 bp, Artificial Sequence
  Synthetic construct
ctacactggctacgtcagactccaggcaaggggctggagtggttggctggt

SEQ ID NO: 4634 - DNA, 51 bp, Artificial Sequence
  Synthetic construct
ctcacctgggtgcgacaggcccccggacaggggcttgagttcatgggaggg

SEQ ID NO: 4635 - DNA, 51 bp, Artificial Sequence
  Synthetic construct
ctcagctggatccgacaggcccctggacaagggcttgagtgggtgggagcc

SEQ ID NO: 4636 - DNA, 51 bp, Artificial Sequence
  Synthetic construct
ctcagctgggtgcgacaggtccctggacaagggcttgagtggatggggggg

SEQ ID NO: 4637 - DNA, 51 bp, Artificial Sequence
  Synthetic construct
ctcagttgggtgcgacaggcccctggacaagggcttgagtggatgggagga

SEQ ID NO: 4638 - DNA, 51 bp, Artificial Sequence
  Synthetic construct
ctgaactgggtccgccaggctccagggaaggggctggagtggatcgcatcc

SEQ ID NO: 4639 - DNA, 51 bp, Artificial Sequence
  Synthetic construct
ctgaactgggtccgccaggctccggggaagggactggagtggatttcatac

SEQ ID NO: 4640 - DNA, 51 bp, Artificial Sequence
  Synthetic construct
ctgaattgggtgcgacaggcccctggacaagggcttgagttgatgggatgg

SEQ ID NO: 4641 - DNA, 51 bp, Artificial Sequence
  Synthetic construct
ctgacctgggtccgccagactccagggagggggttggagtgggtggccaat

SEQ ID NO: 4642 - DNA, 51 bp, Artificial Sequence
  Synthetic construct
ctgacctgggtccgccaggctccagggaagggactggagtgggtcgcccaa

SEQ ID NO: 4643 - DNA, 51 bp, Artificial Sequence
  Synthetic construct
ctgagctgggtccgccaggctccagggaaggggctggagtgggtggccagc

SEQ ID NO: 4644 - DNA, 51 bp, Artificial Sequence
  Synthetic construct
ctgagctgggtccgccaggctcccgggaaggggctggagtgggtcgctttc

SEQ ID NO: 4645 - DNA, 51 bp, Artificial Sequence; identical to SEQ ID NO: 1781
  Synthetic construct

SEQ ID NO: 4646 - DNA, 51 bp, Artificial Sequence
  Synthetic construct
ctgagttggatccgcctgagtccaggcaaggggatggagtgggttggccgt

SEQ ID NO: 4647 - DNA, 51 bp, Artificial Sequence
  Synthetic construct
ctgagttgggtccgccaggctcccgggaagggtctggagtgggtagggctc

SEQ ID NO: 4648 - DNA, 51 bp, Artificial Sequence
  Synthetic construct
ctgcactgggtccgacaggcccctggacaagggcttgagtggatgggaatg

SEQ ID NO: 4649 - DNA, 51 bp, Artificial Sequence
  Synthetic construct
ctgcactgggtccgccaggctccaggcaaggggctggagtgggtgtcagtt

SEQ ID NO: 4650 - DNA, 51 bp, Artificial Sequence
  Synthetic construct
ctgggctggttccgtcggcccccaggaaaggccctagagtggcttgcattc

SEQ ID NO: 4651 - DNA, 51 bp, Artificial Sequence
  Synthetic construct
cttatctgggtgcgccaggcccctggacaagggcctgaatgcatgggatgg

SEQ ID NO: 4652 - DNA, 51 bp, Artificial Sequence
  Synthetic construct
gtacactgggtccgccaggctccaggcaaggggctggagtgggtggcagtg

SEQ ID NO: 4653 - DNA, 51 bp, Artificial Sequence
  Synthetic construct
gtacattggatgcgccaggcccccggacaacggcttgagtggatggggtgg

SEQ ID NO: 4654 - DNA, 51 bp, Artificial Sequence
  Synthetic construct
gtcaactgggtgcgacaggccactggacaaggccttgagtggttgggacgg

SEQ ID NO: 4655 - DNA, 51 bp, Artificial Sequence
  Synthetic construct
gtcaactgggtgcgccaggcccctggacatgggcttgagtggatgggaggc

SEQ ID NO: 4656 - DNA, 51 bp, Artificial Sequence
  Synthetic construct
gtcacctgggtgcgacaggcccctggacaagggcttgagtggatggggggg

SEQ ID NO: 4657 - DNA, 51 bp, Artificial Sequence
  Synthetic construct
gtcacctgggtgcgccaggcccctggacaagggcttgagtgtgtgggacag

SEQ ID NO: 4658 - DNA, 51 bp, Artificial Sequence
  Synthetic construct
gtcacgtgggtgcgacaggcccctggacaagggcttgaatgggtgggagag

SEQ ID NO: 4659 - DNA, 51 bp, Artificial Sequence
  Synthetic construct
gtcagctggatccgtcagcccccagggaaggccctggagtggcttgcacac

SEQ ID NO: 4660 - DNA, 51 bp, Artificial Sequence
  Synthetic construct
gtcagctggatccgtcagcccccagggaaggccctggagtggcttgcacgc

SEQ ID NO: 4661 - DNA, 51 bp, Artificial Sequence
  Synthetic construct
gtcagctgggtgcgacaggcccccggacaaggccttgagtggatgggcgga

SEQ ID NO: 4662 - DNA, 51 bp, Artificial Sequence
  Synthetic construct
gtcagttgggtgcggcaggcccctggacaagcacctgagtggatgggatgg

SEQ ID NO: 4663 - DNA, 51 bp, Artificial Sequence
  Synthetic construct
gtcggctgggtacgccagacgcccgggaaaggcctggagttgatggggatc

SEQ ID NO: 4664 - DNA, 51 bp, Artificial Sequence
  Synthetic construct
gtcggctgggtgcgccagatgcccgggaaaggcctggagtggatgggtatc

SEQ ID NO: 4665 - DNA, 51 bp, Artificial Sequence
  Synthetic construct
gtgacctggattcggcagccccccgggaagggcctggagtggattggggaa

SEQ ID NO: 4666 - DNA, 51 bp, Artificial Sequence
  Synthetic construct
gtgacctgggtccgccaggctccagggaaggcactggagtgggtcggagtt

SEQ ID NO: 4667 - DNA, 51 bp, Artificial Sequence
  Synthetic construct
gtgacctgggtccgccaggctccaggggaggggctggagtgggtaggtttc

SEQ ID NO: 4668 - DNA, 51 bp, Artificial Sequence
  Synthetic construct
gtgagctggatccgtcagcccccagggaaggccccggagtggctagcacgc

SEQ ID NO: 4669 - DNA, 51 bp, Artificial Sequence
  Synthetic construct
gtgagctggatccgtcagcccccagggaaggccctggaatggcttgcacgc

SEQ ID NO: 4670 - DNA, 51 bp, Artificial Sequence
  Synthetic construct
gtgagctggatccgtcagcccccagggaaggccctggagtggcttgcacac

SEQ ID NO: 4671 - DNA, 51 bp, Artificial Sequence
  Synthetic construct
gtgagctggatccgtcagcccccagggaaggccctggagtggcttgcacgc

SEQ ID NO: 4672 - DNA, 51 bp, Artificial Sequence
  Synthetic construct
gtgagctggatccgtcagcccccagggaaggccctggagtggcttgcccac

SEQ ID NO: 4673 - DNA, 51 bp, Artificial Sequence
  Synthetic construct
gtgagctgggtccgccaggctccaggcaaggggctggagtgggtaggtttc

SEQ ID NO: 4674 - DNA, 51 bp, Artificial Sequence
  Synthetic construct
gtgagctgggtccgtcagcccccagggaagggcctggagtggcttgcacgc

SEQ ID NO: 4675 - DNA, 51 bp, Artificial Sequence
  Synthetic construct
gtgagttgggtccgcctgagtccagggaaggggctggagtgggtctcaggt

SEQ ID NO: 4676 - DNA, 51 bp, Artificial Sequence
  Synthetic construct
gtgagttggttccgtcagcccccagggaaggccctggagttccttgcacgc

SEQ ID NO: 4677 - DNA, 51 bp, Artificial Sequence
  Synthetic construct
gtgcactggatccgtcagcccccaggagcggccctggagtggcttgcactc

SEQ ID NO: 4678 - DNA, 51 bp, Artificial Sequence
  Synthetic construct
gtgggctggatccgacagcccccaggaaaggccctggagtggcttggattc

SEQ ID NO: 4679 - DNA, 51 bp, Artificial Sequence
  Synthetic construct
gtgggctggatccgtcagcccccaggaaaggccctggagtggctggcactc

SEQ ID NO: 4680 - DNA, 51 bp, Artificial Sequence
  Synthetic construct
gtgggctggatccgtcagcccccaggaaaggccctggagtggcttgcactc

SEQ ID NO: 4681 - DNA, 51 bp, Artificial Sequence
  Synthetic construct
gtgggctggatccgtcagcccccaggaaaggccctggagtggcttgcattc

SEQ ID NO: 4682 - DNA, 51 bp, Artificial Sequence
  Synthetic construct
gtgggctgggtccgtcagaccccaggaaaggccctggagtggcttgcgctc

SEQ ID NO: 4683 - DNA, 51 bp, Artificial Sequence
  Synthetic construct
gtgggctgggtccgtcagcccccaggaaaggccctggagtggcttgctctc

SEQ ID NO: 4684 - DNA, 51 bp, Artificial Sequence
  Synthetic construct
gtggggtgggtccgccaggctccagggaagggactggagtgggtctcaagt

SEQ ID NO: 4685 - DNA, 51 bp, Artificial Sequence
  Synthetic construct
gttaattgggtccggcaggctcccgggaaggggctggaatggctttcatat

SEQ ID NO: 4686 - DNA, 51 bp, Artificial Sequence
  Synthetic construct
tgcagctggatccggcagcccccagggaagggactggagtggattgggtat

SEQ ID NO: 4687 - DNA, 51 bp, Artificial Sequence
  Synthetic construct
tggaactggatcaggcagtccccatcgagaggccttgagtggctgggaagg

SEQ ID NO: 4688 - DNA, 51 bp, Artificial Sequence
  Synthetic construct
tggaactggatccgacagacaccagggaagggactggagtgggttgggtat

SEQ ID NO: 4689 - DNA, 51 bp, Artificial Sequence
  Synthetic construct
tggaactggatccgacagcccccagggaagggactggagtggattgggtac

SEQ ID NO: 4690 - DNA, 51 bp, Artificial Sequence
  Synthetic construct
tggaactggatccgccaacccccaggggaggggctggagtggattggaaaa

SEQ ID NO: 4691 - DNA, 51 bp, Artificial Sequence
  Synthetic construct
tggaactggatccggcaacccccagggaagcgactggagtggattgggcac

SEQ ID NO: 4692 - DNA, 51 bp, Artificial Sequence
  Synthetic construct
tggaactggatccggcagcccccagggaagggactggagtgggttgggtat

SEQ ID NO: 4693 - DNA, 51 bp, Artificial Sequence
  Synthetic construct
tggaactggatccggcagtccgccgggaagggactggagtggattgggcgt

SEQ ID NO: 4694 - DNA, 51 bp, Artificial Sequence
  Synthetic construct
tggaactggatgcggcagcccgccgggaagggactggagtggattgggcgg

SEQ ID NO: 4695 - DNA, 51 bp, Artificial Sequence
  Synthetic construct
tggaactgggtccggcagcccgccgggaaggggctggagtggattgggcgt

SEQ ID NO: 4696 - DNA, 51 bp, Artificial Sequence
  Synthetic construct
tggaactgggtccggcagcccgccgggaggggactggagtggattgggcgt

SEQ ID NO: 4697 - DNA, 51 bp, Artificial Sequence
  Synthetic construct
tggaactgggtgcggcagtccccagggaagggactggagtggattgggtat

SEQ ID NO: 4698 - DNA, 51 bp, Artificial Sequence
  Synthetic construct
tggaattggatccggcaggccccagggagagaattggagtgggttggatat

SEQ ID NO: 4699 - DNA, 51 bp, Artificial Sequence
  Synthetic construct
tggacatggattcggcagcccccagggaagggactggagtggattggacgt

SEQ ID NO: 4700 - DNA, 51 bp, Artificial Sequence
  Synthetic construct
tggacctggatccgacagtcccccgggaagggactggaatggattggccat

SEQ ID NO: 4701 - DNA, 51 bp, Artificial Sequence
  Synthetic construct
tggacctggatccgccagcccccagggaaggggctggagtggattggggaa

SEQ ID NO: 4702 - DNA, 51 bp, Artificial Sequence
  Synthetic construct
tggacctggatccggcagcccccagggaagggactggagtggattgggtat

SEQ ID NO: 4703 - DNA, 51 bp, Artificial Sequence
  Synthetic construct
tggacctggatccggcagcccccagggaagggactggagtggattggttat

SEQ ID NO: 4704 - DNA, 51 bp, Artificial Sequence
  Synthetic construct
tggacctggatccggcagcccgccggaaagggactggagtggattgggcgt

SEQ ID NO: 4705 - DNA, 51 bp, Artificial Sequence
  Synthetic construct
tggacctggatccggcagcccgccggaaagggactggagtggattggtcgt

SEQ ID NO: 4706 - DNA, 51 bp, Artificial Sequence
  Synthetic construct
tggacctggatccggcagcccgccgggaagggactggagtggattgggcgt

SEQ ID NO: 4707 - DNA, 51 bp, Artificial Sequence
  Synthetic construct
tggacctggatccggcagcccgccgggaagggattggagtggattgggcgt

SEQ ID NO: 4708 - DNA, 51 bp, Artificial Sequence
  Synthetic construct
tggacctggatccggcagcccgccgggaggggcctggagtggattgggcgc

SEQ ID NO: 4709 - DNA, 51 bp, Artificial Sequence
  Synthetic construct
tggacctggatccggcagtccccagggaagggactggagtggattggacat

SEQ ID NO: 4710 - DNA, 51 bp, Artificial Sequence
  Synthetic construct
tggacctggatccggcagtccccagggaagggactggagtggattgggcat

SEQ ID NO: 4711 - DNA, 51 bp, Artificial Sequence
  Synthetic construct
tggacctggattcggcagcccgccgggaagggactggagtggattggacat

SEQ ID NO: 4712 - DNA, 51 bp, Artificial Sequence
  Synthetic construct
tggacctggcttcgacagcccgccggggggcggctggagtggattgggcgt

SEQ ID NO: 4713 - DNA, 51 bp, Artificial Sequence
  Synthetic construct
tggacctgggtccgccagttcccagggaaggggctggagtggattggcgaa

SEQ ID NO: 4714 - DNA, 51 bp, Artificial Sequence
  Synthetic construct
tggacgtggatccgccagcccccaggaaagggcctggagtggattggggaa

SEQ ID NO: 4715 - DNA, 51 bp, Artificial Sequence
  Synthetic construct
tggacttggatccgccagcccccagggaaggggctggagtggattggggat

SEQ ID NO: 4716 - DNA, 51 bp, Artificial Sequence
  Synthetic construct
tggagctggatccgccagcccccagggaaggggctggagtggattggggaa

SEQ ID NO: 4717 - DNA, 51 bp, Artificial Sequence
  Synthetic construct
tggagctggatccgccagcccccagggaaggggctggagtgggtcggggat

SEQ ID NO: 4718 - DNA, 51 bp, Artificial Sequence
  Synthetic construct
tggagctggatccgccagcccccaggtaaggggctggagtggattggggaa

SEQ ID NO: 4719 - DNA, 51 bp, Artificial Sequence
  Synthetic construct
tggagctggatccgccagccccccgggaaggggctggagtggattggggaa

SEQ ID NO: 4720 - DNA, 51 bp, Artificial Sequence
  Synthetic construct
tggagctggatccgccagtccccagggaaggggctggagtggattggggaa

SEQ ID NO: 4721 - DNA, 51 bp, Artificial Sequence
  Synthetic construct
tggagctggatccggcaagccccagggaagggactggagtggattggatat

SEQ ID NO: 4722 - DNA, 51 bp, Artificial Sequence
  Synthetic construct
tggagctggatccggcagccaccagggaagggactggagtggattgggtat

SEQ ID NO: 4723 - DNA, 51 bp, Artificial Sequence
  Synthetic construct
tggagctggatccggcagccaccagggaagggcctggagtggattgggtac

SEQ ID NO: 4724 - DNA, 51 bp, Artificial Sequence
  Synthetic construct
tggagctggatccggcagccaccagggcagggactggagtggattggagat

SEQ ID NO: 4725 - DNA, 51 bp, Artificial Sequence
  Synthetic construct
tggagctggatccggcagcccccagggaagggactggaatggattggatat

SEQ ID NO: 4726 - DNA, 51 bp, Artificial Sequence
  Synthetic construct
tggagctggatccggcagcccccagggaagggactggagtggatcgggtat

SEQ ID NO: 4727 - DNA, 51 bp, Artificial Sequence
  Synthetic construct
tggagctggatccggcagcccccagggaagggactggagtggattggatat

SEQ ID NO: 4728 - DNA, 51 bp, Artificial Sequence
  Synthetic construct
tggagctggatccggcagcccccagggaagggactggagtggattgggtat

SEQ ID NO: 4729 - DNA, 51 bp, Artificial Sequence
  Synthetic construct
tggagctggatccggcagccccccgggaagggactggagtggattgggaat

SEQ ID NO: 4730 - DNA, 51 bp, Artificial Sequence
  Synthetic construct
tggagctggatccggcagccccccgggaagggactggagtggattgggtat

SEQ ID NO: 4731 - DNA, 51 bp, Artificial Sequence
  Synthetic construct
tggagctggatccggcagccccctgggaagggactggagtggattgggtat

SEQ ID NO: 4732 - DNA, 51 bp, Artificial Sequence
  Synthetic construct
tggagctggatccggcagcccgccgggaagggactggagtggattggacga

SEQ ID NO: 4733 - DNA, 51 bp, Artificial Sequence
  Synthetic construct
tggagctggatccggcagcccgccgggaagggactggagtggattgggcgc

SEQ ID NO: 4734 - DNA, 51 bp, Artificial Sequence
  Synthetic construct
tggagctggatccggcagcccgccgggaagggactggagtggattgggcgt

SEQ ID NO: 4735 - DNA, 51 bp, Artificial Sequence
  Synthetic construct
tggagctggatccggcagcccgccgggaagggtctggagtggattggccgt

SEQ ID NO: 4736 - DNA, 51 bp, Artificial Sequence
  Synthetic construct
tggagctggatccggcagtccccagggaagggactggagtggattgggtat

SEQ ID NO: 4737 - DNA, 51 bp, Artificial Sequence
  Synthetic construct
tggagctggatccggcagtccccggggaggggactggagtggatgggatat

SEQ ID NO: 4738 - DNA, 51 bp, Artificial Sequence
  Synthetic construct
tggagctggattcggcagcccccagggaagggactggagtggattggaatt

SEQ ID NO: 4739 - DNA, 51 bp, Artificial Sequence
  Synthetic construct
tggagctgggtccgccagaccccagggaaggggctggagtggattggagag

SEQ ID NO: 4740 - DNA, 51 bp, Artificial Sequence
  Synthetic construct
tggagctgggtccggcagcccccaggaaagggactggaatacattgggtat

SEQ ID NO: 4741 - DNA, 51 bp, Artificial Sequence
  Synthetic construct
tggagttggatccgacagcccccaggaaagggtctggagtgggttgggtac

SEQ ID NO: 4742 - DNA, 51 bp, Artificial Sequence
  Synthetic construct
tggagttggatccgccagcccccaggaagggggctggagtggattggggaa

SEQ ID NO: 4743 - DNA, 51 bp, Artificial Sequence
  Synthetic construct
tggagttggatccgccagcccccagggaagggactggagtggattggagaa

SEQ ID NO: 4744 - DNA, 51 bp, Artificial Sequence
  Synthetic construct
tggagttggatccgccagcccccagggaaggggctggagtggattggggaa

SEQ ID NO: 4745 - DNA, 51 bp, Artificial Sequence
  Synthetic construct
tggagttggatccgccagtccccagggaaggggctggagtggattggggaa

SEQ ID NO: 4746 - DNA, 51 bp, Artificial Sequence
  Synthetic construct
tggagttggatccggcagccaccaggggggagactggaatggattgggaat

SEQ ID NO: 4747 - DNA, 51 bp, Artificial Sequence
  Synthetic construct
tggagttggatccggcaggccccagggaagggactggagtggattggatat

SEQ ID NO: 4748 - DNA, 51 bp, Artificial Sequence
  Synthetic construct
tggagttggattcggcagcccccagggaagggactggagtggattggatat

SEQ ID NO: 4749 - DNA, 51 bp, Artificial Sequence
  Synthetic construct
tggagttgggtccgccagttcccagggaaggggctggagtggattggcgaa

SEQ ID NO: 4750 - DNA, 51 bp, Artificial Sequence
  Synthetic construct
tggagttgggtccggcagcccccaggaaagggactgcaatggatcggaact

SEQ ID NO: 4751 - DNA, 51 bp, Artificial Sequence
  Synthetic construct
tggagttgggtccggcggcccgccggacagggactagagtggattgggcgt

SEQ ID NO: 4752 - DNA, 51 bp, Artificial Sequence
  Synthetic construct
tgggcctggatccgccagccccctgggaaggggctggagtggattgggact

SEQ ID NO: 4753 - DNA, 51 bp, Artificial Sequence
  Synthetic construct
tgggcctggctccgccagtccccgggcaagggactggagtggattgggagt

SEQ ID NO: 4754 - DNA, 51 bp, Artificial Sequence
  Synthetic construct
tgggcttggatccggcaggccccagggaagggactggaatggcttgggagt

SEQ ID NO: 4755 - DNA, 51 bp, Artificial Sequence
  Synthetic construct
tggggctggatccgccagcccccagggaagagtctggagtggattgggagt

SEQ ID NO: 4756 - DNA, 51 bp, Artificial Sequence
  Synthetic construct
tggggctggatccgccagcccccagggaagggactggagtggattgggagt

SEQ ID NO: 4757 - DNA, 51 bp, Artificial Sequence
  Synthetic construct
tggggctggatccgccagcccccagggaaggggctggagtggattgcaagt

SEQ ID NO: 4758 - DNA, 51 bp, Artificial Sequence
  Synthetic construct
tggggctggatccgccagcccccagggaaggggctggagtggattgggagt

SEQ ID NO: 4759 - DNA, 51 bp, Artificial Sequence
  Synthetic construct
tggggctggatccgccagccccccgggaaggggctggagtggattgccagt

SEQ ID NO: 4760 - DNA, 51 bp, Artificial Sequence
  Synthetic construct
tggggctggatccggcagcccccaggaaagggactggagtggattgggtat

SEQ ID NO: 4761 - DNA, 51 bp, Artificial Sequence
  Synthetic construct
tggggctggatccggcagcccccagggaagggactggagtggattggaagt

SEQ ID NO: 4762 - DNA, 51 bp, Artificial Sequence
  Synthetic construct
tggggctggatccggcagcccccagggaagggactggagtggattgggagt

SEQ ID NO: 4763 - DNA, 51 bp, Artificial Sequence
  Synthetic construct
tggggctggatccggcagcccccagggaaggggctggaatggattgggagt

SEQ ID NO: 4764 - DNA, 51 bp, Artificial Sequence
  Synthetic construct
tggggctggatccggcagcccccagggaaggggctggagtggattggaaac

SEQ ID NO: 4765 - DNA, 51 bp, Artificial Sequence
  Synthetic construct
tggggctggatccggcagcccccagggaaggggctggagtggattggattt

SEQ ID NO: 4766 - DNA, 51 bp, Artificial Sequence
  Synthetic construct
tggggctggatccggcagcccccagggaaggggctggagtggattgggact

SEQ ID NO: 4767 - DNA, 51 bp, Artificial Sequence
  Synthetic construct
tggggctggatccggcagcccccagggaaggggctggagtggattgggagt

SEQ ID NO: 4768 - DNA, 51 bp, Artificial Sequence
  Synthetic construct
tggggctggatccggcagcccccagggcaggggctggagtggattggcagt

SEQ ID NO: 4769 - DNA, 51 bp, Artificial Sequence
  Synthetic construct
tggggctggatccggcagccccccactcaggggctagattggattgcgact

SEQ ID NO: 4770 - DNA, 51 bp, Artificial Sequence
  Synthetic construct
tggggctggatccggcagtccccagggaaggggctggagtggattgggaat

SEQ ID NO: 4771 - DNA, 51 bp, Artificial Sequence
  Synthetic construct
tggggctggatccggcagtcccccgggaagggactggactggattgcaagt

SEQ ID NO: 4772 - DNA, 51 bp, Artificial Sequence
  Synthetic construct
tggggctggatgcgccagcccccagggaaggggctggagtggattgggagt

SEQ ID NO: 4773 - DNA, 51 bp, Artificial Sequence
  Synthetic construct
tggggctgggtccggcggcccccagggaaggggctggagtggattgggaat

SEQ ID NO: 4774 - DNA, 51 bp, Artificial Sequence
  Synthetic construct
tggggctggttccggcagtccccaggggggggtctggagtggattgggaac

SEQ ID NO: 4775 - DNA, 51 bp, Artificial Sequence
  Synthetic construct
tggggttggatccggcagcccccagggaagggggtggagtggatagggagt

SEQ ID NO: 4776 - DNA, 51 bp, Artificial Sequence
  Synthetic construct
ttcaactgggtgcgacaggcccctggacaagggcttgagtgggtgggaggg

SEQ ID NO: 4777 - DNA, 51 bp, Artificial Sequence
  Synthetic construct
ttcagctgggtgcgacaggcccctggacaaggccttgagtggataggaggg

SEQ ID NO: 4778 - DNA, 51 bp, Artificial Sequence
  Synthetic construct
ttcagctgggtgcgacaggcccctggacaagggcttgagtggatgggaggc

SEQ ID NO: 4779 - DNA, 51 bp, Artificial Sequence
  Synthetic construct
ttcagttgggtgcgacaggcccccggacaaggtcttgagtggatgggaggg

SEQ ID NO: 4780 - DNA, 51 bp, Artificial Sequence
  Synthetic construct
ttcagttgggtgcgccaggcccctggacaagggcttgagtgggtgggatgg

SEQ ID NO: 4781 - DNA, 51 bp, Artificial Sequence
  Synthetic construct
ttccactgggtccgccaggctccaggcaaggggctggagtgggtggcagtt

SEQ ID NO: 4782 - DNA, 51 bp, Artificial Sequence
  Synthetic construct
ttccactgggtccgccaggctccagggaaggggctggagtgggtctcatcc

SEQ ID NO: 4783 - DNA, 51 bp, Artificial Sequence
  Synthetic construct
ttccactgggtgcaacaggccccggaaaaagggcttgagtggatgggacgt

SEQ ID NO: 4784 - DNA, 51 bp, Artificial Sequence; identical to SEQ ID NO: 1786
  Synthetic construct

SEQ ID NO: 4785 - DNA, 51 bp, Artificial Sequence
  Synthetic construct
ttgacctggatacgcctgattcaagggaggggcctggagtgggtgtcatat

SEQ ID NO: 4786 - DNA, 51 bp, Artificial Sequence
  Synthetic construct
ttgacctgggtccgccaagctccagggaaggggctggaatgggtcgctggt

SEQ ID NO: 4787 - DNA, 51 bp, Artificial Sequence
  Synthetic construct
ttgagctggatccgccaggctccagggagggggctggagtgggtttcatac

SEQ ID NO: 4788 - DNA, 51 bp, Artificial Sequence
  Synthetic construct
ttgcactgggtccgccaggctccaggcaaggggctggagtgggtggctgtt

SEQ ID NO: 4789 - DNA, 51 bp, Artificial Sequence
  Synthetic construct
ttgcactgggtgcgacaggcccctggacaaggccttgagtggatgggatgg

SEQ ID NO: 4790 - DNA, 51 bp, Artificial Sequence
  Synthetic construct
ttgcactgggtgcgacaggctcctggagaaggacttgagtggatgggaggt

SEQ ID NO: 4791 - DNA, 51 bp, Artificial Sequence
  Synthetic construct
ttggcctggatccgtcagccccccggaaaggccctagagtggcttgcatta

SEQ ID NO: 4792 - DNA, 51 bp, Artificial Sequence
  Synthetic construct
tttagttgggttcgacaggcccctggacaagggcttgagtggatgggtggc

SEQ ID NO: 4793 - DNA, 51 bp, Artificial Sequence
  Synthetic construct
tttcactgggtccgccaggctccaggcaaggggctggagtgggtggcagtt

SEQ ID NO: 4794 - DNA, 105 bp, Artificial Sequence
  Synthetic construct
ggggccctcaagagtcgaatcatcatctccctagacacgtccaagaatcagttctccctgaaactgagctctgtgaccgccgcagacacggctgtgtattactgt

SEQ ID NO: 4795 - DNA, 65 bp, Artificial Sequence
  Synthetic construct
gggggaaccagttctccctgacgctgagctctgtgaccgccgcagacacggctatatattactgt

SEQ ID NO: 4796 - DNA, 85 bp, Artificial Sequence
  Synthetic construct
atttggggcagtggacacgtccaagaaccagttctccctgaggctggactctgtgaccgctgcagacacggccgtgtattactgt

SEQ ID NO: 4797 - DNA, 114 bp, Artificial Sequence
  Synthetic construct
aactacaacccgtccctcaagagtcgagtcaccatatcaatagacacgtccaagaagcaggtctccctgaagttgagctctgtgaacgccgcggacacggctgtgtattactgt

SEQ ID NO: 4798 - DNA, 114 bp, Artificial Sequence
  Synthetic construct
aattacgcacagaagttccagggcagggtcaacatcgtcgcggacgtatacacgagcacagcctacatggaggtgaacagcctgacgcctgaggacacggctgtatatttctgc

SEQ ID NO: 4799 - DNA, 114 bp, Artificial Sequence
  Synthetic construct
cattacaacccctccctcaggagtcgtgtcagcatctcactagactcgtcacagaaccaattttctctgcaattgagatctgtgacccccgcagacacggccgtgtatttctgt

SEQ ID NO: 4800 - DNA, 114 bp, Artificial Sequence
  Synthetic construct
aattatgcacagaagttccagggcagagtctccatgaccacagacacatccacgaccacagcctacatggagctgaggagtctgagatctgacgactcggccgtgtactactgt

SEQ ID NO: 4801 - DNA, 114 bp, Artificial Sequence
  Synthetic construct
ggtatcgcacagaagttccagggcagagtcaccatgaccagggacaggtccacgagcacagttttcctggagttgcgcagtctgagatctgacgacacggccgtctattattgt

SEQ ID NO: 4802 - DNA, 114 bp, Artificial Sequence
  Synthetic construct
atgtacgcagagaaatttcagggcagagtcgcgattaccacggacgaatccacgaacacagcctacctggagctgggcggcctgaaatcagaggacacggccgtgtatttttgt

SEQ ID NO: 4803 - DNA, 114 bp, Artificial Sequence
  Synthetic construct
gcatatggtacgtcgatgaagggcaggttcaccttctccagagatgattcaaggagcacggcatatcttcaaataaacagcctgaaacccgaggacacggccgtgtattattgt

SEQ ID NO: 4804 - DNA, 114 bp, Artificial Sequence
  Synthetic construct
tattatgcagactccgtgaagggccgattcaccatctccagggacaactccaagaacacggtgtatctgcaaatgaacagcctgagagctgaggacacggctatgtattactgt

SEQ ID NO: 4805 - DNA, 114 bp, Artificial Sequence
  Synthetic construct
tactatgcagactccgtgaagggccgtttcaccatctccagagacaattccaagaacacggtgtatttacaaatgaacagcctgcgacctgaggacacggctgtttactactgt

SEQ ID NO: 4806 - DNA, 114 bp, Artificial Sequence
  Synthetic construct
tcttatgctgcgtcggtgacaggcaggttcatcatctccagagatgatcccaagaacacggcgtttctgcagatggacagtctgaaaaccgaggacacggccatatattattgt

SEQ ID NO: 4807 - DNA, 114 bp, Artificial Sequence
  Synthetic construct
gactatgcctcgtcggtgagaggcaggttcaccatctccagagatgattcaaagaacacggcgtacttgcaaatgaacagcctgaagaccgaggacacggccgtctattattgt

SEQ ID NO: 4808 - DNA, 114 bp, Artificial Sequence
  Synthetic construct
gtatacggtgcgtcggtgaaaggcaggttcaccatctccagagatgattcgaacaacacggcgtttctgcaaatgagcagcctgaaacccgaggacacggccctgtattattgc

SEQ ID NO: 4809 - DNA, 114 bp, Artificial Sequence
  Synthetic construct
gtatatacagagaagttccagggcagagtcaccatgaccgcgaacacgtcttcagacacagccttcatggagctgagcagcctaagatctgacgacacggccttttattactgt

SEQ ID NO: 4810 - DNA, 114 bp, Artificial Sequence
  Synthetic construct
acctacgcacacaagttccagggcagagtcaccatgaccagggacacgtccacgagcacagtctacatggaactgagcagattgagatctgaggacacggccgtgtattactgt

SEQ ID NO: 4811 - DNA, 114 bp, Artificial Sequence
  Synthetic construct
tactttgcacagaagtttcaaggcagggtcaccatgaccagggacacgtccatcagcacagtctacatggggctgagcagcctgagatctgacgacacggccgtctattactgt

SEQ ID NO: 4812 - DNA, 114 bp, Artificial Sequence
  Synthetic construct
aactatgcacagaagtttcagggcagggtcaccatgaccacagacacgtccatcagtacaacctacttggggctgaggacactgagatctgacgacacggccatattttattgt

SEQ ID NO: 4813 - DNA, 114 bp, Artificial Sequence
  Synthetic construct
acgtatgcccagggcttcacaggacgatttgtcttctccttggacacctccgccactacggcatatctgcagatcaccagcctcaagcctgaggacaccgccgtatattactgc

SEQ ID NO: 4814 - DNA, 114 bp, Artificial Sequence
  Synthetic construct
aagtatgcacagaaatttcagggccgtgtcaccatgaccagggacacgtccatcagcactgcctacatggatataagcagactgacatctgacgacacggccatatattactgt

SEQ ID NO: 4815 - DNA, 114 bp, Artificial Sequence
  Synthetic construct
tactacgcacagaggttcgaggacagagtcaccatgaccgcagacgcgtccactaatacacttttcatggaattgagcagcctgagatctgacgacacggccatatatttctgt

SEQ ID NO: 4816 - DNA, 114 bp, Artificial Sequence
  Synthetic construct
aaaatttcacagagcttgcagggcagagtcaccttgacagcggacacatccgcgaccacatcttacatggagctgagcagcctgacacttgaagacacggctttgtactactgt

SEQ ID NO: 4817 - DNA, 114 bp, Artificial Sequence
  Synthetic construct
gactttgcacagaagtttcgggacagggtcaccatgaccacggacacgtccatcaccacagcctacctggacgtgaccagactgacatctgacgacacggccatttatttctgt

SEQ ID NO: 4818 - DNA, 114 bp, Artificial Sequence
  Synthetic construct
aaatattcacagaacttccaggacagagtcgcctttaccagggacacatccgcgagcactgcctacatggaactgagcagcctgaggtctgaagacacgggtatctattactgt

SEQ ID NO: 4819 - DNA, 114 bp, Artificial Sequence
  Synthetic construct
agatattcacagaatttccagggcagactcaccatgaccagggacacatccgcgaggacagcctacatggagctgagcagcctgacaattgaagacacggctgtgtattattgt

SEQ ID NO: 4820 - DNA, 114 bp, Artificial Sequence
  Synthetic construct
aaatattcacagaccttccaggacagagtctccatcaccacggacacatccgcgaggacagcctacatggagctgagcagcctgagatccgaagacacggctgtgtattactgt

SEQ ID NO: 4821 - DNA, 114 bp, Artificial Sequence
  Synthetic construct
aactatgcacagaagtttcagggcagggtcaccgtgaccagggacacgtccatcagcacagcctacatggagctgagcagtctgcgatttgacgacacggccgtatattactgt

SEQ ID NO: 4822 - DNA, 114 bp, Artificial Sequence
  Synthetic construct
tcatatgcagagagattccagggaagagtcacctttgccgtcgacacgtcaacagacacagtctacatggatttgaagggcctgagatccgaggacacggccgtttattattgt

SEQ ID NO: 4823 - DNA, 114 bp, Artificial Sequence
  Synthetic construct
atatatggagggaagtttcagggcagaatcaccataaccgcagacacgtctacagacacaacctacatggaactgagcagcctgacatctgaagacacggccgtctattattgt

SEQ ID NO: 4824 - DNA, 114 bp, Artificial Sequence
  Synthetic construct
aaatattcacagatgttccaggacagagtcaccattaccagggacacatccgcgaacacagcctacatggaattggccagcctgagatctgaggacagggcgatatatttctgt

SEQ ID NO: 4825 - DNA, 114 bp, Artificial Sequence
  Synthetic construct
ggctatgcacagaagttccagggcagagtcaccattaccaggaacacctccataagcgcagccttcatggagctgagcagcctgacacctgaggacacggccgtgtattactgt

SEQ ID NO: 4826 - DNA, 114 bp, Artificial Sequence
  Synthetic construct
ggctatgcacagaagttccagggcagagtcaccatcaccaggaacaactccataggcacagcctatatggagctgagcagcctgagatctgaggacacggccgtatattattgt

SEQ ID NO: 4827 - DNA, 114 bp, Artificial Sequence
  Synthetic construct
ggctatgcacagaagttccagggcagagtcaccattaccaggaacacctccataagcacagcctacatggagctgagcagcctgagatctgaggacacggccgtgtattactgt

SEQ ID NO: 4828 - DNA, 114 bp, Artificial Sequence
  Synthetic construct
ggctatgcagagaacttccagggcagagtcaccattaccaggaacacctccataagcacagcctacctggaggtgagcagcctaagatctgaggacacggccgtctattactgt

SEQ ID NO: 4829 - DNA, 114 bp, Artificial Sequence
  Synthetic construct
ggctatgcacagaagttccgcggcagagtcaccattaccaggaacacctctacaaacacgacctacatggagctgaccagcctgacatctgacgacacggccgtgtattactgt

SEQ ID NO: 4830 - DNA, 114 bp, Artificial Sequence
  Synthetic construct
ggctatgcacagaagttccagggcagactcaccatttccagggacacctccataagcacagcctacatggagctgagcaacctgagatctgaggacacggccgtgtattactgc

SEQ ID NO: 4831 - DNA, 114 bp, Artificial Sequence
  Synthetic construct
aactacgcacagaactttcagggcagagtcacaatcaccacggacgaatccacgagcacaacctacatggagctgagcagcctgagatctgaggacacggccgtgtatttttgt

SEQ ID NO: 4832 - DNA, 114 bp, Artificial Sequence
  Synthetic construct
aactacgcacggaagttccagggcagagtcacgattaccgcggacgaatccacgaacacagtctacatggacttgcgcagcctgacgtctgaagacacggccacatacttctgt

SEQ ID NO: 4833 - DNA, 114 bp, Artificial Sequence
  Synthetic construct
ggctatgcacagaagttccagggcagagtcaccattaccagggactcctccataagcacagcctacatggatctgagcagcctgagatctgaggacacggccgtgtattactgt

SEQ ID NO: 4834 - DNA, 114 bp, Artificial Sequence
  Synthetic construct
aactatgcacagaagctccagggcagagtcaccatgaccacagacacatccacgaagacagcctacatggagctgaggagcctgagatctgacgacacggccgtgtattactgt

SEQ ID NO: 4835 - DNA, 114 bp, Artificial Sequence
  Synthetic construct
aactacgcacagaagttccagggcagagtcacgattaccgcggacgaatccatgaacacagtctacatggagctcagcagcctgagatctgaagacacggccgtctattattgt

SEQ ID NO: 4836 - DNA, 114 bp, Artificial Sequence; identical to SEQ ID NO: 1790
  Synthetic construct

SEQ ID NO: 4837 - DNA, 114 bp, Artificial Sequence
  Synthetic construct
acctatgcccaggacttcacaggacggtttgacttctccttggattcctctgcgagcacggcatatctgcagatcagcagtctccaggctgacgacactgccatctattactgt

SEQ ID NO: 4838 - DNA, 114 bp, Artificial Sequence
  Synthetic construct
acctacgcacagaaattccagggcagagtcacctttaccacggacgtgtctacgagtacagactacctggagctgagcagcctgagatctgacgacacggccgtctattactgt

SEQ ID NO: 4839 - DNA, 114 bp, Artificial Sequence
  Synthetic construct
aactacgcacagaagttgcaggacagagtcacgattaccacggacgaatccacgaccacagcctacatggagctgcgcagcctgacatctgaggacacggccatgtattactgt

SEQ ID NO: 4840 - DNA, 114 bp, Artificial Sequence
  Synthetic construct
gactacgcacagaagttccagggcagagtcacgattaacacggacgaatccacgagcacagcctacatggaactgagtagcctgagatctgaggacacggccgtctattactgt

SEQ ID NO: 4841 - DNA, 114 bp, Artificial Sequence
  Synthetic construct
aagtatgcacagaagttccaggacagagtcaccttgaccaccgacacatcttcgagcacagcctacatggaactgagggagttgagagttgacgacacggccctgtattattgt

SEQ ID NO: 4842 - DNA, 114 bp, Artificial Sequence
  Synthetic construct
aactatgcacagaagttccagggcagagtcgccttgaccacagacacatccacgagcacagcctacatggagctgaggagcctgagatctgacgacacggccgtgtattactgt

SEQ ID NO: 4843 - DNA, 114 bp, Artificial Sequence
  Synthetic construct
aactccgcagagaagttccaggacagagtcacgattaccgcggacgaatccacgagcacagcctacatggagctgagcagcctgagatctgatgacacggccgtgtattactgt

SEQ ID NO: 4844 - DNA, 114 bp, Artificial Sequence
  Synthetic construct
aattatgcacagaagttccaggacagaaccaccatgaccacagacacatccacgaacacagcctacatggagctgaggagcctgagatctgacgacacggccgtatattactgt

SEQ ID NO: 4845 - DNA, 114 bp, Artificial Sequence
  Synthetic construct
aactatgcacagaacctccagggcagagtcaccatgaccgcagacacatccacgcgcacagcctacatggaactgaggagcctgagatttgacgacgcggccgtctattactgt

SEQ ID NO: 4846 - DNA, 114 bp, Artificial Sequence
  Synthetic construct
aactacgaacagaagttgcagggcagagtcacgattaccgcggacggatctacgggcacagcctacatggagctgagaaacctgacatatgaggacacggccgtctattattgt

SEQ ID NO: 4847 - DNA, 114 bp, Artificial Sequence
  Synthetic construct
aactacgcccagaagtttcagggaagggtgacaatttctgcagacaaaagtaccaatacagcctatatggagctgtcaagcctgcgctctgaagataccgccgtgtactattgt

SEQ ID NO: 4848 - DNA, 114 bp, Artificial Sequence
  Synthetic construct
aactacgcccagaagtttcagggaagggtgacaatttctgcagacaaaagtaccaatacagcctatatggacctgtcaagcctgcgctctgaagataccgccgtgtactattgt

SEQ ID NO: 4849 - DNA, 114 bp, Artificial Sequence
  Synthetic construct
aactacgcccagaagtttcagggaagggtgacaatttctgcagacaaaagtaccaatacagcctatatggagctgtcaagcctgcactctgaagataccgccgtgtactattgt

SEQ ID NO: 4850 - DNA, 114 bp, Artificial Sequence
  Synthetic construct
aactacgcccagaagtttcagggaagggtgacaatttctgcagacaaaagtaccaatacagcctatatggagctgtcaagcctgcattctgaagataccgccgtgtactattgt

SEQ ID NO: 4851 - DNA, 114 bp, Artificial Sequence
  Synthetic construct
aactacgcccagaagtttcagggaagggtgacaatttctgcagacaaaagtaccaatacagcctatatggagctgtcaagcctgcgctctgaagataccgccgtgtacttttgt

SEQ ID NO: 4852 - DNA, 114 bp, Artificial Sequence
  Synthetic construct
aacttcgcacagaagttccagggcagagtcacgattagtacggacgacctcgctaggacagtgtacatggagctgagcagcctgagatctgacgacacggccgtatactactgc

SEQ ID NO: 4853 - DNA, 114 bp, Artificial Sequence
  Synthetic construct
aactatgcacagaatctgtacgacagagtcagcatgaccacagacacaaccacgaacacagccgacatggagctgaggagcctgacatctgacgacacggccgtgtattactgt

SEQ ID NO: 4854 - DNA, 114 bp, Artificial Sequence
  Synthetic construct
aactatgcacagaagtttcagggcagagtcacgattaccgcggacgaatcttcgagcacagtctacattgaagtgagcagactgagatctgaggacacggccgtgtattactgt

SEQ ID NO: 4855 - DNA, 114 bp, Artificial Sequence
  Synthetic construct
acttatgcacaagagttccagggcagagtcacgattaattcggacgaatccacgaccacagcctttatggaactgaacagcctgagatctgaggacacggccgtgtattactgt

SEQ ID NO: 4856 - DNA, 114 bp, Artificial Sequence
  Synthetic construct
aactacgcgcagaagttccagggcagagtcacgataaccgcggacgtatccacgaatacagtctacatggagatcagcagcctgagatctgaggacacggccgtgtattactgt

SEQ ID NO: 4857 - DNA, 114 bp, Artificial Sequence
  Synthetic construct
aactacgcacagaagttccagggcagagtcacgattaccacggacgaatccacgagcacagcctacatggagttgagcagcctgagatctgaggacacggccgtgtattactgt

SEQ ID NO: 4858 - DNA, 114 bp, Artificial Sequence
  Synthetic construct
aactacgcacagaagttccagggcagagtcacgattaccacggacgaatccacgagcacagcctacatggagctgagcagcctgagatctgaggacacggccgtgtattactgt

SEQ ID NO: 4859 - DNA, 114 bp, Artificial Sequence
  Synthetic construct
gagtacgcacagaagttccagggcagagtcacgattaccacggacgaatccacgagcacagcctacatggacctgagtagcctgagatctgaggacacggccgtgtatttctgt

SEQ ID NO: 4860 - DNA, 114 bp, Artificial Sequence
  Synthetic construct
aactacgcacagaagttccagggcagagtcacgattaccacggacgaatccacgaagacagcctacatggagctgagcagcctgagatctgaggacacggccgtgtattactgt

SEQ ID NO: 4861 - DNA, 114 bp, Artificial Sequence
  Synthetic construct
gtctatgcacagaacctccagggcagagtcaccgtgaccgtagacacatccacgagcacagtctacatggagctgaggagccttagatctgacgacacggccgtctattactgt

SEQ ID NO: 4862 - DNA, 114 bp, Artificial Sequence
  Synthetic construct
aactatggacagaaattccagggcagagtcaccatgaccacagacacatcgacgagtacagcctacatggaactgaggagcctgagatctgacgacacggccgtgtattattgt

SEQ ID NO: 4863 - DNA, 114 bp, Artificial Sequence
  Synthetic construct
aactatgcacagaaggtccagggcagagtcaccatgaccacagacacatccacgagcacagcctatatggagctgagtagcctgagatctgacgacacggccgtgtattactgt

SEQ ID NO: 4864 - DNA, 114 bp, Artificial Sequence
  Synthetic construct
aactatgcacagaagctccagggcagagtcaccatgaccacagacacatccacgagcacagcctacatggagctgaggagcctgagatctgacgacacggccgtgtattactgt

SEQ ID NO: 4865 - DNA, 114 bp, Artificial Sequence
  Synthetic construct
aactatgcacagaaactccagggcagagtcaccatgaccacagacacatccacgagtacagcctacatggagctgacgagcctgaaatctgacgacacggccgtgtattactgt

SEQ ID NO: 4866 - DNA, 114 bp, Artificial Sequence
  Synthetic construct
aattatgcagtgaatttccaggacagagtcaccctcaccacggacgaatccacgaacactgcctacatggaactgagcgaccttaaatctgacgacacggccgtctatttctgt

SEQ ID NO: 4867 - DNA, 114 bp, Artificial Sequence
  Synthetic construct
aactatgcacagaaactccagggcagagtcaccatgaccacagacacatccacgagcacggcctacatggagctgaggagcctgagatctgacgacacggccctgtattactgt

SEQ ID NO: 4868 - DNA, 114 bp, Artificial Sequence
  Synthetic construct
gagtacgcacagagtttccaggacagactcacgattacggcggacaagtccacgaacaccgtgtacatggacttgagtagcctgacatctgaggacacggccgtttacttctgt

SEQ ID NO: 4869 - DNA, 114 bp, Artificial Sequence
  Synthetic construct
cactacgcacagaagttccagggcagagttacgattaccgcggacgaatccacgagcacagcctacatggagctgaccagcctgacatctgaagacacggccctttattactgt

SEQ ID NO: 4870 - DNA, 114 bp, Artificial Sequence
  Synthetic construct
aattatgcacagaggatccaggacagagtcaccatgaccacagacacatcaacggacacagtctacatggacttgaggagcctgacatctgacgacacggccgtctattactgt

SEQ ID NO: 4871 - DNA, 114 bp, Artificial Sequence
  Synthetic construct
aactacgcacagaagttccggggcagagtcacgataaccaaggacgaatccacgagcacagcctacatggagctgagcagcctgagatatgaagacacggccgtctattactgt

SEQ ID NO: 4872 - DNA, 114 bp, Artificial Sequence
  Synthetic construct
gataaggcacagaagttccagggcagagtcacatttaccgcggacgactccacgagcacggcctacatggaattgagcagcctgagatctgaagacacggccgtctattactgt

SEQ ID NO: 4873 - DNA, 114 bp, Artificial Sequence
  Synthetic construct
acttacgcagagaagtttaagggcagagtcaccttgaccacagacacatccacgaccacagcctacatggaactgaggagcctgagatctgacgacacggccatatacttctgt

SEQ ID NO: 4874 - DNA, 114 bp, Artificial Sequence
  Synthetic construct
aacaacgcacagaaattccaggccagagtcacccttaccgcggacgaagcaacgaacacagcctacatggagctgagcagcctccaatttgaggacactgccatatattactgt

SEQ ID NO: 4875 - DNA, 114 bp, Artificial Sequence
  Synthetic construct
aactatgtccagagtctccagggcagagtcacaatgaccacagacacagccacgaacacagcctacatggagctgaggagcctgcgatctgacgacacggccgtctatttctgt

SEQ ID NO: 4876 - DNA, 114 bp, Artificial Sequence
  Synthetic construct
aactatgcacagaggctccagggcagagtcaccatgaccacagatacatccacgaacacagcctacatggagctgaggagcctgagatctgacgacacggccgtgtattactgt

SEQ ID NO: 4877 - DNA, 114 bp, Artificial Sequence
  Synthetic construct
cactacgcgcaggacttccagggcagagtcaccattacttcggacgaatcgacgagctcagcctacatgcagttgagcagcctcaggtctgacgacacggccgtatacttctgt

SEQ ID NO: 4878 - DNA, 114 bp, Artificial Sequence
  Synthetic construct
acctatgccccgggcttcagaggacggattgtcttgtccttaaacacttctgtcaattcggcttacctacaaatcgacaacgtaaggcctgaggacactgccgtctatttctgt

SEQ ID NO: 4879 - DNA, 114 bp, Artificial Sequence
  Synthetic construct
ctttttgcagagagtttccatgacagaatcgccataaccgcggacacgtccacagccaccgccttcatggaattgaggagcctgagatctgaggacacggccgtgtattattgt

SEQ ID NO: 4880 - DNA, 114 bp, Artificial Sequence
  Synthetic construct
tactacgcagactccgttaagggacgattcactttgtccagagacaactccaagagtacagtgttcctgaagatgaacagtctgagaattgaggacacgggtgtgtattactgt

SEQ ID NO: 4881 - DNA, 114 bp, Artificial Sequence
  Synthetic construct
aaatatgcagagaagttccggggcagagtcaccataaccgcagacacatctacaaacacagcctacatggaattgagcagcctgagatttgaggacacggccatttattactgt

SEQ ID NO: 4882 - DNA, 114 bp, Artificial Sequence
  Synthetic construct
aagtacggaaagaacatccccgacagagtcacgattaccgcggacgaatcgtcgagcacagcctatttggagatgagctccctgagatctgaagacacggccatttattactgt

SEQ ID NO: 4883 - DNA, 114 bp, Artificial Sequence
  Synthetic construct
tcctacgcagggaggttccagggcagagtcaccctgaccagggacacgtctagaaacacagtctacatggaactgagcagcctgacttctgaggacacggccgtatattactgt

SEQ ID NO: 4884 - DNA, 114 bp, Artificial Sequence
  Synthetic construct
aactatgcacagaagtttcagggcaggatcaccatggccagggacacgtccatcatcacagcctacatggacctgagcaggctgaaatctgacgacacggccgtctattactgt

SEQ ID NO: 4885 - DNA, 114 bp, Artificial Sequence
  Synthetic construct
aagtattcgcagacctttcagggcagggtcaccatgaccagggacacgtccatcagcacagcctacatggagctgagcaggctgagatctgacgatacggccttctattactgt

SEQ ID NO: 4886 - DNA, 114 bp, Artificial Sequence
  Synthetic construct
ctctacgcacagatgttccagggcagagtcaccatgaccgaggactcaactggtgccacagccgacctggagctgagcagcctgacatctgaggacacggccgtctattactgt

SEQ ID NO: 4887 - DNA, 114 bp, Artificial Sequence
  Synthetic construct
atctccgcacagaaattccaggccagagtcaccatgaccgcggacggatcttcagacacagcctacatggaactgagtagcctaagatctgaggacacggccgtctattactgt

SEQ ID NO: 4888 - DNA, 114 bp, Artificial Sequence
  Synthetic construct
tactttccgcagaagttccagggcagagtctccattaacagggacacctccataaccaccgcctatatggaactgaagagcctgacatctgaagacacggccgtctactactgt

SEQ ID NO: 4889 - DNA, 114 bp, Artificial Sequence
  Synthetic construct
gacttcccaccgaaatttaagggccgagtctccatgaatagggacacgtccacgaatacagcccacttggacctgaacagcctgagatctgaggacacggccatctattattgt

SEQ ID NO: 4890 - DNA, 114 bp, Artificial Sequence
  Synthetic construct
gaatatgcaccgaagtttcagggcagactcaacattctcgcggaacagtctacgcgaacagtctacatggaactgagtggcctgtcacgtgacgacacggccatttattactgt

SEQ ID NO: 4891 - DNA, 114 bp, Artificial Sequence
  Synthetic construct
aaatactcacagatgttccagggcagagtcaccattaccaccgatacatccgcgagcacagcctacatggagctgagcagcctgagatatgaagacacggctgtgtattattgt

SEQ ID NO: 4892 - DNA, 114 bp, Artificial Sequence
  Synthetic construct
agatacagcccgtccttccaaggccaggtcaccatctcagccgacaagtccatcagcaccgcctacctgcagtggagcagcctgaaggcctcggacaccgccatgtattactgt

SEQ ID NO: 4893 - DNA, 114 bp, Artificial Sequence
  Synthetic construct
agatacagcccgtccttccgaggccaggtcaccatctcagccgacaagtccaacaacaccgcccacctgcagtggagcagcctgaaggcctcggacaccgccatttattattgt

SEQ ID NO: 4894 - DNA, 114 bp, Artificial Sequence
  Synthetic construct
agatacagcccgtccttccaaggcctggtcaccatctcagccgacaagtccaccacgaccgcctacctgcagtggggcagcctgaaggcctcggacaccgccatgtattattgt

SEQ ID NO: 4895 - DNA, 114 bp, Artificial Sequence
  Synthetic construct
agatatggcccgtccttccaaggccaggtcagcatttcagccgacaagtccaagagcaccgcctacttgcagtggggcagcctgaaggcctcggacagcgccatgtattactgt

SEQ ID NO: 4896 - DNA, 114 bp, Artificial Sequence
  Synthetic construct
agatacagcccgtccttccaaggccaggtcctcatctcagccgacaagtccagcagcaccgcctacctacagtggagcagcctgaaggcctcggacaccgccatgttttactgt

SEQ ID NO: 4897 - DNA, 114 bp, Artificial Sequence
  Synthetic construct
agatacagcccgtccttccaaggccaggtcaccatctcagccgacaagtccatcaataccgcctacctgcaatggagtagcctgaaggcctcggacagcgccatttattactgt

SEQ ID NO: 4898 - DNA, 114 bp, Artificial Sequence
  Synthetic construct
agatacagtccgtccttgcaaggccaggtcatcatctcagtcgacacctcaataaataccgcctacctacattgggacagcctgaaggcctcggacaccgccatatattactgt

SEQ ID NO: 4899 - DNA, 114 bp, Artificial Sequence
  Synthetic construct
agatacagcccgtccttcgaaggccaggtcaccgtctcagtcgacaagtccatcagcaccgcctacctgcagtggagcagcctgaaggcctcggacagcgccatgtatttctgt

SEQ ID NO: 4900 - DNA, 114 bp, Artificial Sequence
  Synthetic construct
agatacagtccgtccttccaaggccaggtcaccatgtcagccgacaggtccgtcaacaccgcctacctgcagtggagcagcctgaaggcctcggacaccgccatgtattactgt

SEQ ID NO: 4901 - DNA, 114 bp, Artificial Sequence
  Synthetic construct
agatacagcccgtccttccaaggccaggtcaccatctcagtcgacacgtccatcaacaccgcctacctgcactggagcagcctgaaggcctcggacaccgccatgtattactgt

SEQ ID NO: 4902 - DNA, 114 bp, Artificial Sequence
  Synthetic construct
agatacaacccgtccttccaaggccaggtcaccatctcagccgacaagtccatcagcaccgcctacctgcagtggaacaacctgaaggcctcggacaccgccatgtattgctgt

SEQ ID NO: 4903 - DNA, 114 bp, Artificial Sequence
  Synthetic construct
agatggagtccgtccttccaaggccaggtcaccctctcagtcgacaagtccgtcaacaccgcctacctgcagtggaacaacttgagggcctcggacaccgccatgtatttttgt

SEQ ID NO: 4904 - DNA, 114 bp, Artificial Sequence
  Synthetic construct
agatatagtccgtccttcgaaggccaggtcaccatctcagccgacaagtccatcagcaccgcctacctgcagtggagcagcctgaaggcctcggacaccgccatctattactgt

SEQ ID NO: 4905 - DNA, 114 bp, Artificial Sequence
  Synthetic construct
atatacagcccgtccttccagggccaggtcaccatctcagccgacaagtccatcagcaccgcctacctgcagtggagcagtctgaaggcctcggacaccgccatgtattattgt

SEQ ID NO: 4906 - DNA, 114 bp, Artificial Sequence
  Synthetic construct
agatacagcccgtccttccaaggtcaggtcaccatctcagccgacaagtccatcagcaccgcctacctgcagtggagtagcctgaaggcctcggacaccgccatttattactgt

SEQ ID NO: 4907 - DNA, 114 bp, Artificial Sequence
  Synthetic construct
acatacagcccggccttccaaggccaggtcaccatctcagccgacaagtccatcagaaccgcctatttgcagtggagcagcctgaaggcctcggacaccgccatgtattactgt

SEQ ID NO: 4908 - DNA, 114 bp, Artificial Sequence
  Synthetic construct
agatacagcccgtccttccaaggccaggtcaccatctcagccgacaagtccatcagcaccgcctacctgcagtggggcagcctgaaggcctcggacaccgccatgtattactgt

SEQ ID NO: 4909 - DNA, 114 bp, Artificial Sequence
  Synthetic construct
atatatagcccgtccttccaaggccgggtcactctctcagtcgacaagtccatcagcaccgcctacctacagtggagcagcctggaggcctcggacaccgccatatattactgt

SEQ ID NO: 4910 - DNA, 114 bp, Artificial Sequence
  Synthetic construct
aaatatagcccgtccttccaaggccaggtcaacatctcagccgacaagtccatcagcaccgcctacctgcagtggagcagcctgaaggcctcggacaccgccatgtattactgt

SEQ ID NO: 4911 - DNA, 114 bp, Artificial Sequence
  Synthetic construct
agatacagtccgtccttccaaggccaggtcaccatctcagtcgacaagtccaccagcaccgcctacctgcagtggagcagcctgaaggcctcggacagcgccatgtattactgt

SEQ ID NO: 4912 - DNA, 114 bp, Artificial Sequence
  Synthetic construct
agatacagcccgaccttccacggccaggtctccatctcagccgacaggtccatcaataccgtctacttgcagtggagcagtctgaaggcctcggacaccgccatgtattactgt

SEQ ID NO: 4913 - DNA, 114 bp, Artificial Sequence
  Synthetic construct
agatacagcccgtccttccaaggccaggtcaccatctcagccgacaagtccatcagcaccgcctacctgcagtggaccagcctgaaggcctcggacaccgccatgtattactgt

SEQ ID NO: 4914 - DNA, 114 bp, Artificial Sequence
  Synthetic construct
agatacagcccgtccttccaaggcgaggtcgccatctcagccgacaactccatcagcaccgcctacctgcaatggagcagcctgaaggcctcggacaccgccatgtactactgt

SEQ ID NO: 4915 - DNA, 114 bp, Artificial Sequence
  Synthetic construct
agagtcagcccgtccttccaaggccaggtcaccatctcagccgacaagtccatcagaaccgcctacctgcagtggagcagcctgaaggcctcggacaccgccatgttttactgt

SEQ ID NO: 4916 - DNA, 114 bp, Artificial Sequence
  Synthetic construct
agatataacccgtccttccacggccaaggcaccatctcagccgacaggtccagcagcgtcgcctacttggagtggagcagcctgagggcctcggacaccgccatgtacttctgt

SEQ ID NO: 4917 - DNA, 114 bp, Artificial Sequence
  Synthetic construct
aaaatttcacagaaattccagggcagagtcaccatcaccagggacaaatccgcgaacacagcccacctggaggtgagaagactgagtcacgaagacacggctctatattactgt

SEQ ID NO: 4918 - DNA, 114 bp, Artificial Sequence
  Synthetic construct
aactacgctgagaagtttaagggcagagtcacaattacgacggacgaatccacgacgacaacctacatggaactaaacagtttgacatctgaagacacggccgtctatttctgt

SEQ ID NO: 4919 - DNA, 114 bp, Artificial Sequence
  Synthetic construct
tactacgcagactctgttatgggccgattcaccatctccagagacaacgccaagaattcagtgtttctgcaaatgaacagcctgagagccgcggacacggctgtatattattgt

SEQ ID NO: 4920 - DNA, 114 bp, Artificial Sequence
  Synthetic construct
tactacgcagcctccgtgaagggccggttcaccatttccagagacaattccaagaacaggctatatctacaaatgaacagccttagagccgaggacacggccgtatattactgt

SEQ ID NO: 4921 - DNA, 114 bp, Artificial Sequence
  Synthetic construct
tattatgcagactctgtgaggggccgattcaccatctccagagacaacgccaagaattccctggctctgcagatgaacagcctgagagtcgaggacacgggtgtttatttttgt

SEQ ID NO: 4922 - DNA, 114 bp, Artificial Sequence
  Synthetic construct
gactacgctgcacccgtgaaaggcagattcaccatctcaagagatgattcagaaaacacgttgtttctgcaaatgaacagcctgaaaaccgacgacacagccgtgtattactgt

SEQ ID NO: 4923 - DNA, 114 bp, Artificial Sequence
  Synthetic construct
cattatggagactctgtgaagggccgattcaccatctccagagacaacgccaagaactctctctatctgcacatgaacaacctgagagccgaggacacggctgtttatttctgt

SEQ ID NO: 4924 - DNA, 114 bp, Artificial Sequence
  Synthetic construct
aactacgcagactcagtgaagggccgattcaccgtctccagagacaacgccaagaactcactgtatctgcagatgaacagcctgagagccgaggacacggctgtgtattactgt

SEQ ID NO: 4925 - DNA, 114 bp, Artificial Sequence
  Synthetic construct
tactacgcagactccgtgaagggccggttcaccatctccagagacaattccaagaacacgctgtatctgcaagtgaacagcctgagagccgaggacacggccgtatattactgt

SEQ ID NO: 4926 - DNA, 114 bp, Artificial Sequence
  Synthetic construct
tactacgcagactctatgaagggccgattcaccatctccagagacaacgccaagaactcactgtatctgcaaatgaagaccctgagagccgaggacacggctgtctattactgt

SEQ ID NO: 4927 - DNA, 114 bp, Artificial Sequence
  Synthetic construct
tactacgcagactccgtgaggggccggttcaccatctccagagacaattccaagaacacgctgtatctggacatgaagagcctgagagacgaggacacggccatatattactgt

SEQ ID NO: 4928 - DNA, 114 bp, Artificial Sequence
  Synthetic construct
tactacgcagactccgtggagggccggttcaccatctccagagacaattccaagaaaatcctgtatctgcaaattaacagcctgagagtcgaggacacggccgtatattactgt

SEQ ID NO: 4929 - DNA, 114 bp, Artificial Sequence
  Synthetic construct
tactacgcagactccgcgaagggccggttcaccatctccagagacaattccaagaatacgctgtatctgcaaatgaacagcctgagagccgaggacacggccgtatattactgt

SEQ ID NO: 4930 - DNA, 114 bp, Artificial Sequence
  Synthetic construct
tcctacgcagactccgtgaagggccgattcaccatctccagagacaacgccaagaactcactttatctggacatgaacagcgtgagagtcgaggacacggctgtttattactgt

SEQ ID NO: 4931 - DNA, 114 bp, Artificial Sequence
  Synthetic construct
gactacgcagcctcagtgaagggccgcttcaccatctccagagacaacgccaagaacttactgtatcttcaaatgaacagcctgagggacgaggacgcggctgtgtattactgt

SEQ ID NO: 4932 - DNA, 114 bp, Artificial Sequence
  Synthetic construct
tactacgcagactcactgaagggccgactgaccatctccagagacaacgccaagaaaacactgtttctgcaaatgaacagcctgagagccgaagacacggctgtgtattactgt

SEQ ID NO: 4933 - DNA, 114 bp, Artificial Sequence
  Synthetic construct
aactacgcagactcagtgaagggccgagtctccatctccagagacaacgccaagaactcactgtatctgcaaatgaacagcctgacagccgaggacacggctctgtattactgt

SEQ ID NO: 4934 - DNA, 114 bp, Artificial Sequence
  Synthetic construct
gactacgcagagtcagtgaagggccgattcaccatttccagagacaacgccaagaactcactgtatctgcaaatgaatagcctgacagccgaggactcggctgtatatttctgt

SEQ ID NO: 4935 - DNA, 114 bp, Artificial Sequence
  Synthetic construct
tactacgcagactctgtgaagggccgttttaccatctccagagacaacgccaagaactcactgcatctgcaaatgaacagcctgagagccgaggacacgggtatatattactgt

SEQ ID NO: 4936 - DNA, 114 bp, Artificial Sequence
  Synthetic construct
tattacgcagactcactgaagggccgaatcaccatctccagagacaacgccaagaactcactgtatctgcaaatgaacagcctgagagtcgaggacacgggtgtctattactgt

SEQ ID NO: 4937 - DNA, 114 bp, Artificial Sequence
  Synthetic construct
tattacgcagactcagtgaagggccgattcaccgtctccagagacaacgccaagaactctctgtatctgcaaatgaacagcctgcgagccgaggacacggctgtgtattactgc

SEQ ID NO: 4938 - DNA, 114 bp, Artificial Sequence
  Synthetic construct
tactacgcagactcagtgaagggccgattcaccatctccagagacaacgccaagaactcactgtatctgcaaatgaacagcctgagacccgaggacacggctgtgtattactgt

SEQ ID NO: 4939 - DNA, 114 bp, Artificial Sequence
  Synthetic construct
tactacgcagactcagtgaagggccgattcaccatctccagagacaacgccaagaactcactgtatctgcaaatgaacagcctgagagccgaggacacggctgtgtattactgt

SEQ ID NO: 4940 - DNA, 114 bp, Artificial Sequence
  Synthetic construct
tattacgcagactcagtgcagggccgattcaccatctccagagacaactccaagaattcactgtatctgcaaatgaacaacctgacagccgaggacacggctgtctattactgt

SEQ ID NO: 4941 - DNA, 114 bp, Artificial Sequence
  Synthetic construct
tactacgcagactctgtgaagggccgattcaccatctccagagacaacgccaagagctcactgtatctgcaaatgaataacctgagagccgaggacacggctgtttattactgt

SEQ ID NO: 4942 - DNA, 114 bp, Artificial Sequence
  Synthetic construct
tactacgcagactctgtgaagggccgattcaccatctccagagacaacgccaagaactcactatatctgcaaatgaacagcctgagagccgaggacacggctgtttattactgt

SEQ ID NO: 4943 - DNA, 114 bp, Artificial Sequence
  Synthetic construct
tactacgcagactctgtggagggccgattcatcgtctccagagacaacgccgagaactcactatatctgcaaatgaacagcctgacagtcgaggacacggctgtttattactgt

SEQ ID NO: 4944 - DNA, 114 bp, Artificial Sequence
  Synthetic construct
tactacgcagactctgtgaagggccgattcaccatctccagagacaacgccaagaactcactgtatctgcaattgaacagcctgagagccgaggacacggctgtctattactgt

SEQ ID NO: 4945 - DNA, 114 bp, Artificial Sequence
  Synthetic construct
tactacgcagactctgtgaagggccgattcaccatctccagagacaacgccaagaactcactgtatctgcaaatgaacagcctgagagccgaggacacggctgtttattattgt

SEQ ID NO: 4946 - DNA, 114 bp, Artificial Sequence
  Synthetic construct
tactacgcaggctctgtgaagggccgattcaccatctccagagacaacgccaagaactccctgtatctgcaaatgaacagcctgagagccgaggacacggctgtttattactgt

SEQ ID NO: 4947 - DNA, 114 bp, Artificial Sequence
  Synthetic construct
tactactcagactctgtgaagggccgattcaccgtctccagagacaacgccaaaaactcactatatctgcaattgaacagcctgagacccgaagacacggctgtttattattgt

SEQ ID NO: 4948 - DNA, 114 bp, Artificial Sequence
  Synthetic construct
tactacgcagactctgtgaagggccgattcaccatctccagagacaacgccaagaactcactgtatctgcaaatgaacagcctgagagccgaggacacggctgtttattactgt

SEQ ID NO: 4949 - DNA, 114 bp, Artificial Sequence
  Synthetic construct
tactacgcagagtctgtgaagggccgattcaccatctccagagacaacgccaagaactcactgtatctgcaaatgaacagcctgagagccgaggacacggctgtttattactgt

SEQ ID NO: 4950 - DNA, 114 bp, Artificial Sequence
  Synthetic construct
tattatgtagattcagtgaagggccgattcaccatctccagagacaacgccaagaactcactgtatctgcaaatgaatagcctgcgagccgaggacacggcagtatattactgt

SEQ ID NO: 4951 - DNA, 114 bp, Artificial Sequence
  Synthetic construct
aactacgcagactctgtgaagggccgattcaccgtctccagagacaacgccaagaactcattgcatctgcaaatgaatagcctgagagccgaggacacggcggtttattattgt

SEQ ID NO: 4952 - DNA, 114 bp, Artificial Sequence
  Synthetic construct
tattacgcagactctgtgaagggccgattcaccatctccagagacaacgccaagaattcagtttttctacagatggacaacctgagagccgaggacacggctgtctattactgt

SEQ ID NO: 4953 - DNA, 114 bp, Artificial Sequence
  Synthetic construct
cactacgcagactctgtgaagggccgattcaccatctccagagacaacgccaagaacgcactgtatctacaaatggagagcctgagagccgacgacacggctgtttatttctgt

SEQ ID NO: 4954 - DNA, 114 bp, Artificial Sequence
  Synthetic construct
tactacgcagactctgtgaagggccggtttatcatttccagagacaaagccaagaattcactgtatctgcaaatgaatagcctgagggtcgaggacacggctgtttattactgt

SEQ ID NO: 4955 - DNA, 114 bp, Artificial Sequence
  Synthetic construct
tcctacgcagactcagtgaagggccgattcaccatctccagagacaacgccaagaactcactatatctccaattgaacagcctgagagtcgaggacacggctctatattactgt

SEQ ID NO: 4956 - DNA, 114 bp, Artificial Sequence
  Synthetic construct
tacatcgcagactcagtgaagggccgattcaccgtctccagagacaacgccaagagcactctgtttctgcagatgaacgacctgagagccgacgacacggcatattattactgt

SEQ ID NO: 4957 - DNA, 114 bp, Artificial Sequence
  Synthetic construct
tattatgtagactcagtgaagggccgattcaccatctccagagacaacgccaagagctcattgtatctgcaaatgaccagcctgagcgccgaggacacggctgtttattactgt

SEQ ID NO: 4958 - DNA, 114 bp, Artificial Sequence
  Synthetic construct
aactacgcacagaagttccagggcagagtcacgattaccgcggacgagtccacgagcacagcctacatggagctgagcagcctgagatctgaggacacggccgtgtattactgt

SEQ ID NO: 4959 - DNA, 114 bp, Artificial Sequence
  Synthetic construct
tactacgcagactctgtgaagggccgattcaccatctccagggacaacgccaagaactcactgtttctgcaaatggacagcctgagagccgaggactcggctgtgtattactgt

SEQ ID NO: 4960 - DNA, 114 bp, Artificial Sequence
  Synthetic construct
aatgtcgcaggctctgtgaggggccgattcaccatgtccagggacaacgccaagaattccctgtatctgcaaatggacagcctgacagtcgaggacacggctgtctactactgt

SEQ ID NO: 4961 - DNA, 114 bp, Artificial Sequence
  Synthetic construct
tcttacgcagactcagtgaagggccgattcaccatctccagagacaacgccaagaactcactgtttctgcaaatgaacagcctgagagccgacgacacggctgtttattactgt

SEQ ID NO: 4962 - DNA, 114 bp, Artificial Sequence
  Synthetic construct
tattcctcagactcagtgaagggccgattcaccatttccagggacaatgccaagagattattgtctttagaaatggaaggtctgagggacgacgactcgggtgtctattactgt

SEQ ID NO: 4963 - DNA, 114 bp, Artificial Sequence
  Synthetic construct
tatgatgcagattctgtgaagggccgattcaccatctccagagacaacgccaagaattcactgtatctgcaaatgaacagcctgagagccgaggacacggctatttattactgt

SEQ ID NO: 4964 - DNA, 114 bp, Artificial Sequence
  Synthetic construct
tactacgcagactctgtgaagggccgattcaccatctccagagacaacgccaacaactcactgtatctgcaaatgaacagcctgagagccgaggacacggctgtttattattgt

SEQ ID NO: 4965 - DNA, 114 bp, Artificial Sequence
  Synthetic construct
tactacgcggactctgtgaagggccgattcaccatatccagagacaacgccaagaattcagtgtttctagaagtgagcagcctgagagccgaagacacggctctgtactactgt

SEQ ID NO: 4966 - DNA, 114 bp, Artificial Sequence
  Synthetic construct
gaccacgctgcacccgtgaaaggcagattcaccatctcaagagatgattcaaaaaacaccctgtttctgcaaatggacagcctgaaaaccgaggacacagccatttattactgt

SEQ ID NO: 4967 - DNA, 114 bp, Artificial Sequence
  Synthetic construct
tactatgcagactctgtgaagggccgattcaccatctccagagacaacgccaagaagtccgtgaccctgcaaatgaatagtctgaaagtggaggatacggctctttacttctgt

SEQ ID NO: 4968 - DNA, 114 bp, Artificial Sequence
  Synthetic construct
tactacctagactcagtgaagggccgattcaccatttccagagacaacgcccagaactcactgcatctgcaaatggacagcctgagagccgaggacacggctgtctattactgt

SEQ ID NO: 4969 - DNA, 114 bp, Artificial Sequence
  Synthetic construct
acgtatgcccagggcttcacaggacggtttgtcttctccttggacacctctgtcagcacggcatatctgcagatcagcagcctaaaggctgaggacactgccgtgtattactgt

SEQ ID NO: 4970 - DNA, 114 bp, Artificial Sequence
  Synthetic construct
acgtatgcccagggcttcacaggacgatttgtcttctccttggacacctctggcagcacggcatatctgcagatcagcagcctaaaggctgaggacactgccatatattactgt

SEQ ID NO: 4971 - DNA, 114 bp, Artificial Sequence
  Synthetic construct
acgtacgcccagggcttcactggacggtttgtcttctccttggacagctctgtcagtacggcatatctgcagatcaccagcctaaaggctgaggacactgccatgtattactgt

SEQ ID NO: 4972 - DNA, 114 bp, Artificial Sequence
  Synthetic construct
atgtatgcccagggcttcacaggacggtttgtcttctccttggacacgtctgtcaacacggcatatttggagatcactagcctgaagactgaggacagtgccgtttattactgt

SEQ ID NO: 4973 - DNA, 114 bp, Artificial Sequence
  Synthetic construct
acttatgcccagggcttcacaggacgctttgtcttctccatggacacctctgtcagcacggcatatctgcagatcagcagcctaagggctgctgatagtgccgtgtattattgt

SEQ ID NO: 4974 - DNA, 114 bp, Artificial Sequence
  Synthetic construct
agttatgcagactctgtgaagggccggttcaccatctccagagacaacgccaagaactccctccatctgcaaatgaacagtctgagagccgaggacacggccttgtattactgt

SEQ ID NO: 4975 - DNA, 114 bp, Artificial Sequence
  Synthetic construct
ggttatgcagactctgtgaagggccgcttcaccatctccagagacaacgccaagaattccgtctttctacaaatgaacagtttgagagccgaggacacggccctctattactgt

SEQ ID NO: 4976 - DNA, 114 bp, Artificial Sequence
  Synthetic construct
gactacgcagactccgtgaagggccggttcaccatctccagagacaattccaagaacacactgtatctgcacatgtacagcctgagagccgaggacacggccctgtattactgt

SEQ ID NO: 4977 - DNA, 114 bp, Artificial Sequence
  Synthetic construct
tattacgcagactccgtgaagggccggttcaccatctccagagacaattccaagaacacactttatctgcaaatgaacagcctgagagccgaggacacggccgtatattactgt

SEQ ID NO: 4978 - DNA, 114 bp, Artificial Sequence
  Synthetic construct
gaatacgccgcgtttgtgaaaggcagattcaccatctcaagagctgattccaaaagcatcgcctatctgcaaatgaacagcctggaaaccgaggacacagccgtgtattactgt

SEQ ID NO: 4979 - DNA, 114 bp, Artificial Sequence
  Synthetic construct
tactacgcagactccgtgaagggccggttcagcatctccagagacaaaaccaagaacaccctatatctgcaaatgaccagcctgagagccgaagacacggccgtatatttctgc

SEQ ID NO: 4980 - DNA, 114 bp, Artificial Sequence
  Synthetic construct
ttttacgcagactccgtgaagggccggttcaccatctccagagacaattccaagaatacgctgtttttgcaaatgaacagcctgagagccgacgacacggccgtatatttctgt

SEQ ID NO: 4981 - DNA, 114 bp, Artificial Sequence
  Synthetic construct
tattatgtggactctatggagggccgattcaccatctccagagacaacaccctgaactcagtgtttctgcaaatgaagagcctgagagccgaggacacggctgtgtattactgt

SEQ ID NO: 4982 - DNA, 114 bp, Artificial Sequence
  Synthetic construct
tactacgcagactccgtgaagggccggttcaccatctccagagacaactccaagaacacgctttatctgcaaatgaacaccctgagagccgaagacacggccgtatattactgt

SEQ ID NO: 4983 - DNA, 114 bp, Artificial Sequence
  Synthetic construct
tactacgcagactttgtgaagggccggctcatcatctccagagacaattccaagagtaggctgtatctgcaaatgagcagcctgagagtcgaggacacggccgtatattactgt

SEQ ID NO: 4984 - DNA, 114 bp, Artificial Sequence
  Synthetic construct
tactacgcagactccgtgaggggccgcttcaccatctccagagacaattccaggaacattctgtatctggaaatgcacaacctgagtctcgacgacacggccacatattactgt

SEQ ID NO: 4985 - DNA, 114 bp, Artificial Sequence
  Synthetic construct
ttctacgcagactccgtgaagggccggttcaccatctccagagacaattccaagaacaccctgtatctggaagtgaacagcctgagagccgacgacgcggccgtttattactgt

SEQ ID NO: 4986 - DNA, 114 bp, Artificial Sequence
  Synthetic construct
tactatgtggactctgtgaagggccgattcaccatctccagagacaacgccaagaactcactgtatctgcaaatgaacagcctgagagccgaggacacggctgtgtattactgt

SEQ ID NO: 4987 - DNA, 114 bp, Artificial Sequence
  Synthetic construct
tcctatgtggactctgtgaggggccgattcaccatctccagagacaacgccaagaactcactgtacctgcaaatgaacagcctgagagccgaggacacggctgtgtattactgt

SEQ ID NO: 4988 - DNA, 114 bp, Artificial Sequence
  Synthetic construct
tactacgcagactctgtgaagggccgattcaccatctccagagacagcgccaagaagtcagtccatctgcaaatgaacagcctgagagtcgaggacacggctctttattactgt

SEQ ID NO: 4989 - DNA, 114 bp, Artificial Sequence
  Synthetic construct
gaatttgccgcgtctgtgaaaggcagattctccatctcaagagaagactcgaaaggcatcgcccatctgcaaatgaacagtctgaaaaccgaggacacagccgtgtacttctgt

SEQ ID NO: 4990 - DNA, 114 bp, Artificial Sequence
  Synthetic construct
ttttacgcagactccgtgaagggccggttctccatctccagagacaattccaagaacactctatttttgcaaatgaacagcctgagagccgacgacacggccatttatttctgt

SEQ ID NO: 4991 - DNA, 114 bp, Artificial Sequence
  Synthetic construct
acctatgtggactccattaggggccgattcttcatctccagagacaacgccaggaactcagtgtacctgcacatgaacagcctgagagtcgacgacacggctatctattactgt

SEQ ID NO: 4992 - DNA, 114 bp, Artificial Sequence
  Synthetic construct
gaatatggcgcgtccgtgaaaggcagattcaccatctcgagagatgatcccaaaagcatcgcctatctgcaaatgaccaccctgaaaaccgacgacacagccgtgtacttctgt

SEQ ID NO: 4993 - DNA, 114 bp, Artificial Sequence
  Synthetic construct
ttttatgcggactctgtgaagggccgattcagcatttcgagaaacaatggttataatactttgactctcgaaatgagaaacctgagagtcgacgacacggctgtctactattgc

SEQ ID NO: 4994 - DNA, 114 bp, Artificial Sequence
  Synthetic construct
tattacgcagactctgtgaagggccgattcaccatctccagggacaacgccaacaattccttgtatctacaaatgaccagcctgagagccgacgacacggctgtctattattgt

SEQ ID NO: 4995 - DNA, 114 bp, Artificial Sequence
  Synthetic construct
tactacgcagactctgtggagggccgattctccatctccagggacaacgccaggaactcactatttttgcaaatgaacagcctgagagtcggagacacggctgtatattactgt

SEQ ID NO: 4996 - DNA, 114 bp, Artificial Sequence
  Synthetic construct
tactacgcggactccgtgaagggccggttcaccatctccagagacaactccaagaatacactatatctgcagatgaacagcctgagagccgaggacacggccctgtattactgt

SEQ ID NO: 4997 - DNA, 114 bp, Artificial Sequence
  Synthetic construct
tactacgcagactccgtgaagggccgcctcaccatctccagagacaataccaagaacacactgtttctgcaaatgaacagcctgagagtcgaggacacggccgtctattattgt

SEQ ID NO: 4998 - DNA, 114 bp, Artificial Sequence
  Synthetic construct
tactacgcagactctgtgaagggccgattcaccatctccagggacaacgccaagaactcactgaatctgcaaatgaatagcctgagagccgaggacacggctgtatattactgt

SEQ ID NO: 4999 - DNA, 114 bp, Artificial Sequence
  Synthetic construct
tactacgcagactctgtgaagggccgattcaccatctccagggacaacgccaagaactcactgtatctgcaaatgaacagcctgagagccgaggacacggctgtgtattactgt

SEQ ID NO: 5000 - DNA, 114 bp, Artificial Sequence
  Synthetic construct
tactacgcagactctgtgaagggccgattcaccatctccagggacaccgccaagaactcactgtatctgcaaatgaacagcctgagagccgaggacacggctgtgtattactgt

SEQ ID NO: 5001 - DNA, 114 bp, Artificial Sequence
  Synthetic construct
agttacgcagactctgtgaagggccgattcaccatctccagggacaacgccaagagctcactgtttctggaaatgaacaccctgagagccgaggacacggctgtgtacaactgt

SEQ ID NO: 5002 - DNA, 114 bp, Artificial Sequence
  Synthetic construct
tactacgcagactctctgttgggccgcttcaccgtctccagggacaacgccaagaactctctgtatctgcaaatgagcagcctgagatccgacgacacggctgtgtattactgt

SEQ ID NO: 5003 - DNA, 114 bp, Artificial Sequence
  Synthetic construct
tactatgcagactctgtgaagggccgattcaccatctccagggacaacgccaacaactcactgtatctgcaaatgaacagtctgagagccgaggacacggctatatattactgt

SEQ ID NO: 5004 - DNA, 114 bp, Artificial Sequence
  Synthetic construct
ggttatgcagactctgtgaaggaccgattcgccatctccagagacaatggcaagaactccctatatctggaattgaacagtctgggggtcgaggacacggccgtctactactgt

SEQ ID NO: 5005 - DNA, 114 bp, Artificial Sequence
  Synthetic construct
ttctacggcggctccgtggggggccgcttcaccatttccagagataattccgaaaacatggtttttctacaaatgaacaacctcagaggcgacgacacggccgtatattactgt

SEQ ID NO: 5006 - DNA, 114 bp, Artificial Sequence
  Synthetic construct
gactacgcagactccgtgaagggtcgattcaccatctccagagacaattccaacaatacgttgtttctgcaaatgaccagcctgagagccgacgacacggccatatattactgc

SEQ ID NO: 5007 - DNA, 114 bp, Artificial Sequence
  Synthetic construct
tacgacgcagactccgtgaagggccgattcaccatctccagagacagttccaagaacactctgtttctgcaaatgaatagcctgataaccgaggacacggccgtatatttctgt

SEQ ID NO: 5008 - DNA, 114 bp, Artificial Sequence
  Synthetic construct
tattacgcagactccgtgaagggcagattcaccatctccagagacaattccaagaatatactgtatcttcaaatgaacagcctgagagccgaggacacggctgtgtatttctgt

SEQ ID NO: 5009 - DNA, 114 bp, Artificial Sequence
  Synthetic construct
gaattcggcgcacccgtgaaaggcaggttcaccatctcaagagatgattcaaaaaacacggtgtatctacagatgaacagcctgaaaaccgaggacacagccgtgtattactgt

SEQ ID NO: 5010 - DNA, 114 bp, Artificial Sequence
  Synthetic construct
gaatacgccgcgtctgtgaaaggcagattcaccatctcaagagatgtatccagaagcatcgcctatctgcaaatgaacagcctgaaaaccgaagacacagccctttattactgt

SEQ ID NO: 5011 - DNA, 114 bp, Artificial Sequence
  Synthetic construct
gaatacgccgcgtctgtgaaaggcagattcaccatctcaagagatgattccaaaagcatcgcctatctgcaaatgaacagcctgaaaaccgaggacacagccgtgtattactgt

SEQ ID NO: 5012 - DNA, 114 bp, Artificial Sequence
  Synthetic construct
ttctatggagactccgtgaagggccgattcaccatctccagacacaattccaacaacacggtgtttcttcaaatgaatagcctgagacctgaggacacggccgtctattactgt

SEQ ID NO: 5013 - DNA, 114 bp, Artificial Sequence
  Synthetic construct
tattatgcagactccgttaacggccgattcaccatctccagacacaattccaagaacacgctgtatcttcaaatgaacagcctgagagcggaggacacggccgtttattactgt

SEQ ID NO: 5014 - DNA, 114 bp, Artificial Sequence
  Synthetic construct
tactacgcagactccgtgaagggccggttcaccatctccagagacaattccaagaacacggtgtatctgcaaatgaacagcctgagagacgaggacacggccgtatattactgt

SEQ ID NO: 5015 - DNA, 114 bp, Artificial Sequence
  Synthetic construct
tactacgcagactccgtgaagggccggttcaccatctccagagacaattccaagaacacgctgtttttgcaaatgaacagcctgagagccgaggacacggccgtatattactgt

SEQ ID NO: 5016 - DNA, 114 bp, Artificial Sequence
  Synthetic construct
tatcacgcagactccgtgaagggccggttcaccatctccagagacaattccaagaacactctgtatctgcaaatgagcagcctgagagccgaggacacggccgtatattactgt

SEQ ID NO: 5017 - DNA, 114 bp, Artificial Sequence
  Synthetic construct
gagtacgcagactccgtgaagggccggttcaccatctccagagacaactccaagaacacactgtatctgcaaatgaacagcctgagagccgaggacacggccatatattactgt

SEQ ID NO: 5018 - DNA, 114 bp, Artificial Sequence
  Synthetic construct
tactacgcagactccgtgaagggccggttcaccatctccagagacaattccaagaacacgctgtatctgcaaatgaacagcctgagagccgaggacacggccgtatattactgt

SEQ ID NO: 5019 - DNA, 114 bp, Artificial Sequence
  Synthetic construct
tactacgcagactccgtgaagggccggttcaccatctccagagacaattccaagaacacgctgtatctgcaaatgaacagcctgagagccgaggacacggccgtcttttactgt

SEQ ID NO: 5020 - DNA, 114 bp, Artificial Sequence
  Synthetic construct
tattacgcagactccgtgaagggccggttcaccatttccagagagtattccaagaacagcctgtatctgcaaatgcacagcctcagagccgaagacacggccgtttattactgt

SEQ ID NO: 5021 - DNA, 114 bp, Artificial Sequence
  Synthetic construct
tactacgcagactccgcgaggggccggttcaccatctccagagacaattccaagaacacagtgtatctgcacatgaacagcctgagagccgaggacacggccgcatattactgt

SEQ ID NO: 5022 - DNA, 114 bp, Artificial Sequence
  Synthetic construct
tactacgcagactccgtgaagggccggttcaccatctccagagacaattccaagaacacgctgtatctgcaaatgaacagcctgagagccgaggacacggccatatattactgt

SEQ ID NO: 5023 - DNA, 114 bp, Artificial Sequence
  Synthetic construct
tcctatacagactccgtgaagggccggttcatcatctccagagacaatttgaagaacacgctgtttctgcaaatgaacagcctgagagtcgaggatacggccgtatactactgt

SEQ ID NO: 5024 - DNA, 114 bp, Artificial Sequence
  Synthetic construct
tactacgcagactccgtgaagggccgattcaccatctccagagacaattccaagaacacgctgtatcttcaaatgaacagcctgagagccgaggacacggccgtgtattactgt

SEQ ID NO: 5025 - DNA, 114 bp, Artificial Sequence
  Synthetic construct
tactacgcagactccgtgaagggccgattcaccatctccagagacagttccaagaacacgctgtatcttcaaatgaacagcctgagagccgaggacacggccgtgtattactgt

SEQ ID NO: 5026 - DNA, 114 bp, Artificial Sequence; identical to SEQ ID NO: 1789
  Synthetic construct

SEQ ID NO: 5027 - DNA, 114 bp, Artificial Sequence
  Synthetic construct
tactatgtggactctgtgaagggccgattcaccatctccagagacaacgccaagaactcactgtatctgcaaatgaacagcctgagagccgaggacacggctgtgtatttctgt

SEQ ID NO: 5028 - DNA, 114 bp, Artificial Sequence
  Synthetic construct
tacttggtggactctgtgaagggccgattcaccatctccagagacaacgccaagaactcactgtatctgcaaatgaacagcctgagagccgaggacacggctgtgtattactgt

SEQ ID NO: 5029 - DNA, 114 bp, Artificial Sequence
  Synthetic construct
ttctatgtggactctgtgaagggccgattcaccatctccagagacaacgccaagaaatcactgtatctgcaaatgaacagcctgagagccgaggacacggctgtgtattattgt

SEQ ID NO: 5030 - DNA, 114 bp, Artificial Sequence
  Synthetic construct
gcatatgtggactcgctgaagggccgattcatcatctccagagacaacgcccagaactcactgtttctgcaaatgaacagcctgacagtcgaggacacggctgtctattactgt

SEQ ID NO: 5031 - DNA, 114 bp, Artificial Sequence
  Synthetic construct
gactacgctgcacccgtgaaaggcagattcaccatctcaagagatgattcaaaaaacacgctgtatctgcaaatgaacagcctgaaaaccgaggacacagccgtgtattactgt

SEQ ID NO: 5032 - DNA, 114 bp, Artificial Sequence
  Synthetic construct
gactacgctgcacccgtgaacggcagattcatcatctcaagagaagattcaaaaaacacactgtatctgcaaatgaacagcctgaaaaccgaggacacagccgtgtattactgt

SEQ ID NO: 5033 - DNA, 114 bp, Artificial Sequence
  Synthetic construct
gactacgctgcacccgtgaaaggcagattcaccatctcaagagatgattcaaaaaactcgctgtatctgcaaatgaacagcctgaaaaccgaggactcagccgtgtattactgt

SEQ ID NO: 5034 - DNA, 114 bp, Artificial Sequence
  Synthetic construct
gaatacgccgcgtctgtgagaggcagattcaccatctcaagagatgatggcaaaagcatcgcctatctgcaaatgaacaacctgcgaaccgaggacacagccgtgtattactgt

SEQ ID NO: 5035 - DNA, 114 bp, Artificial Sequence
  Synthetic construct
tactacgcagactccgtgaagggccggttcaccatctccagagacaattccaagtacacgctgtatctacaaatgaacagcctgagagccgaggacacggccgtatattactgt

SEQ ID NO: 5036 - DNA, 114 bp, Artificial Sequence
  Synthetic construct
tactatgtggactctgtgaagggccgattcaccatctccagagacaacgccaagaactcactgtatctgcaaattaacagcctgagagccgaggacacggctgtgtattcctgt

SEQ ID NO: 5037 - DNA, 114 bp, Artificial Sequence
  Synthetic construct
atctatgtggactctgtgaagggccggttcaccatctccagagacaacgccaagaactctctgtttctgcaaatggacagcctgagaggcgaagacactggtctttattactgt

SEQ ID NO: 5038 - DNA, 114 bp, Artificial Sequence
  Synthetic construct
tactacgcagagtccgtgaagggccgattcaccatctctcgagacaattccaagaacactttgtatcttcaaatgaacagcctgagagtcgacgacacggccgtctattactgt

SEQ ID NO: 5039 - DNA, 114 bp, Artificial Sequence
  Synthetic construct
aattatgtggactctgtgaagggccgattcaccatctccagagacaacgcccagaattcagtgtttctgcaaatgaggcgcctgagagtcgaggacacggctgtctactattgt

SEQ ID NO: 5040 - DNA, 114 bp, Artificial Sequence
  Synthetic construct
tactacgcagactctgtgaggggccgattcaccgtgtccagggaccaggccaaaaactcactgtttttgcaaatgaacagtctgagagtcgaggacacggctgtatattactgt

SEQ ID NO: 5041 - DNA, 114 bp, Artificial Sequence
  Synthetic construct
acttatgcagactctgtgaagggccgattcaccatcgccagggacaacgccaggaactccctctacctgcaaatgaatggtctgggacccgacgacacggccctttatttctgt

SEQ ID NO: 5042 - DNA, 114 bp, Artificial Sequence
  Synthetic construct
tacgggttgggctctgtggggggccgattcaccatctccagagacaacgccaagaactcactgtatctccaaatgaacagcctgagagccgaggacacggctgtgtattactgt

SEQ ID NO: 5043 - DNA, 114 bp, Artificial Sequence
  Synthetic construct
tcctacgcagagtctgtgaagggccgattcaccgtctccagagacaacgccaggaactcactgtatctgcacatgaatagcctgagagccgaggacacgggtgtttattattgt

SEQ ID NO: 5044 - DNA, 114 bp, Artificial Sequence
  Synthetic construct
gaatacgccgcgtctctgaaaggcagattcaccatctcaagagatgattccagaagcatcgcctatctgcaaatgaacagcctgaaaatcgaggacacagccgtgtattactgt

SEQ ID NO: 5045 - DNA, 114 bp, Artificial Sequence
  Synthetic construct
ctctactcagactccgtgaagggccggttcaccatctccagagacaattccaaaaacacactgtatctgcaaatcaacagcctgagagccgaagacacggccatatatcactgt

SEQ ID NO: 5046 - DNA, 114 bp, Artificial Sequence
  Synthetic construct
tactacgcagactccgtgaagggccgtttcaccatctccagagacaattccaagaacacggtgtatctggaaatgaacagcctgaaagccgaggacacggccgtatattactgt

SEQ ID NO: 5047 - DNA, 114 bp, Artificial Sequence
  Synthetic construct
aactatgtggactctgtgaagggccgattcatcatctccagagacaatgccaagaactcagtgtatctgcaaatgaacagcctgagagtcgaggacacggctatctattattgt

SEQ ID NO: 5048 - DNA, 114 bp, Artificial Sequence
  Synthetic construct
aattatgtggcctctgtggagggcagattcaccatctccagagacgacagcaagaggtctgtagatttgcagatggacaggctgacagccgaagacacggccatctatttctgt

SEQ ID NO: 5049 - DNA, 114 bp, Artificial Sequence
  Synthetic construct
cattatgtcgactctgtgaagggtcgattcaccatctccagagacaacaccaacagttcattgtttctgcaaatgagtaggctgagagtcgaggacacggctgtttattactgc

SEQ ID NO: 5050 - DNA, 114 bp, Artificial Sequence
  Synthetic construct
gactacgccgcacccgtgagaggcagattcaccatttcaagacatgattcattagacacactgtctctacaaatgaacaacgtgacagccgacgacgcagccgtctattactgt

SEQ ID NO: 5051 - DNA, 114 bp, Artificial Sequence
  Synthetic construct
tattatacagactccgtgaagggccgcttcaccatctccagagacagctccaagaacatccttcatctccaattggacagtctgaaagtcgaggactcggccctttattattgt

SEQ ID NO: 5052 - DNA, 114 bp, Artificial Sequence
  Synthetic construct
aagtatgcacagaagttccagggcagagtcacgatcaccacggacgaatccacaaggacagtctacatggaactgagtagcctgacatctgacgacacggccgtttattattgt

SEQ ID NO: 5053 - DNA, 114 bp, Artificial Sequence
  Synthetic construct
tactacgcagactccgtgaagggccgattcaccgtctccagggacaacgccaagaagtcactgtatctgcaaatgaacagcctgagagccgaggacacggctgtgtattactgt

SEQ ID NO: 5054 - DNA, 114 bp, Artificial Sequence
  Synthetic construct
tactatgcagactccgtgaagggccggttcaccatctccagagacaattccaagaacacggtgtatctacaaatgaatagcctgagagtcgaggacacggccgtatattattgt

SEQ ID NO: 5055 - DNA, 114 bp, Artificial Sequence
  Synthetic construct
tactatgcagactccgtgaagggccggttcaccatctccagagacaattccaagaacatggtgtatctacaaatgaatagcctgagagtcgaggacacggccgtatattattgt

SEQ ID NO: 5056 - DNA, 114 bp, Artificial Sequence
  Synthetic construct
tactatgctgactctctgaggggccgattcaccatctccagagacaactccaagaatttactctctctacaaatgaacagcctgcgagccgaggacacggctctttatttctgc

SEQ ID NO: 5057 - DNA, 114 bp, Artificial Sequence
  Synthetic construct
gtttatgcagaccttttgtatggcagagtcaccatgaccgcggacgcgtcgacagacacagcctacctggagctgagcggcctgacatctgaagacacggccctttatttctgt

SEQ ID NO: 5058 - DNA, 114 bp, Artificial Sequence
  Synthetic construct
tattatgcagactctgtgaagggccgactcaccatttccagagacaactccaagaaaacagtctttttgcaaatgaatagcctgagaaatgaggacacaggtatatattattgt

SEQ ID NO: 5059 - DNA, 114 bp, Artificial Sequence
  Synthetic construct
cgctacgcggactccgtgaagggccgattcaccatctccagagacaacgccaagaacacactgtatctgcaaatgaacagtctgagagccgaggacacggctgtatattactgt

SEQ ID NO: 5060 - DNA, 114 bp, Artificial Sequence
  Synthetic construct
aactacgcagactcagtgaagggccgattcagcacctccagagacaacgccaagaactccctatatctgcaaatgagtagcctgagagtcgaagacacggctgtctattactgt

SEQ ID NO: 5061 - DNA, 114 bp, Artificial Sequence
  Synthetic construct
tattatgcagactccgtgaagggcagattcaccatctccagagacaacgccaggaacacggtgtatcttcagatgggcagcctgagacctgaggacacggctttatattactgt

SEQ ID NO: 5062 - DNA, 114 bp, Artificial Sequence
  Synthetic construct
tactacgcagactccgtgaagggccgagttaccatctccagagacaattccgaggacaccctatatctccacatgaatagcctgagaatccaggacacggctgtttatcactgt

SEQ ID NO: 5063 - DNA, 114 bp, Artificial Sequence
  Synthetic construct
tactttgcagactccgtgaagggccgatgcaccatctccagagacaattccaagaacacgctgtatctgcaaatgaacagcctgagagctgaggacacggctgtgtattactgt

SEQ ID NO: 5064 - DNA, 114 bp, Artificial Sequence
  Synthetic construct
aggtatgcagactccgtgaagggccgattcaccgtctccagagacaattccaagaacacgctgtttctgcaaatggacagcctgagaccggaggacacggctgtgtacttctgt

SEQ ID NO: 5065 - DNA, 114 bp, Artificial Sequence
  Synthetic construct
tattacgcagactccgtgaggggccgattcaccatctccagagacaactccaagaacacattatttctgcaaatgatcaggctgagacttgaggacacctctgtttattattgt

SEQ ID NO: 5066 - DNA, 114 bp, Artificial Sequence
  Synthetic construct
tactacgcagactccgtgaggggccgattcatcatttccagagacaattccaagaacacgctgtatctgcaaatgaacagcctgaaacctgaggacacggctgtgtattactgt

SEQ ID NO: 5067 - DNA, 114 bp, Artificial Sequence
  Synthetic construct
tattacgcagactccgtgaagggccgattcaccatctccagagacaattccaagaacacgctgtatttgcaaatgaacagcctgagacctgacgacacggctgtgtattactgt

SEQ ID NO: 5068 - DNA, 114 bp, Artificial Sequence
  Synthetic construct
tactacgcagactccgtgaagggccgattcaccatctccagagacgattccaagaacaccctgtatctgcaaatgaacagcctgagaactgaggacacggctgtgtattactgt

SEQ ID NO: 5069 - DNA, 114 bp, Artificial Sequence
  Synthetic construct
cagtatggagagaccgttaagggccgattcaccatctccagagacaatcccaagaacacactatatctgcaaatgaacagcctgagagtcgacgacacggctgtatattattgt

SEQ ID NO: 5070 - DNA, 114 bp, Artificial Sequence
  Synthetic construct
cgctacgcagactccgtgaagggccgattcaccatctccagagacaactccaagaacacgctgtctctgcagatgaacagcctgagagctgacgactcggctgtatatttctgt

SEQ ID NO: 5071 - DNA, 114 bp, Artificial Sequence
  Synthetic construct
ttctacgcagactccgtgaagggccgattcatcatctccagagacaactccaagaacacgctgtatctggaaatgaacagcctgagagctgaggacacggctgtgtattactgt

SEQ ID NO: 5072 - DNA, 114 bp, Artificial Sequence
  Synthetic construct
tactatgcagactccgtgaagggccgattcaccatctccagagacaattccaagaacacgctgtatctgcaaatgaatagcctgagagctgaggacacggctgtgtatttctgt

SEQ ID NO: 5073 - DNA, 114 bp, Artificial Sequence
  Synthetic construct
tactacggagactccgtggagggccgattcaccatctccagagacaattccaagaatatgttgtatctgcaaatgaacagcctgagagctgaggacacggctgtgtatttctgt

SEQ ID NO: 5074 - DNA, 114 bp, Artificial Sequence
  Synthetic construct
tattacgcagactccgtgaagggccgattcaccatctccagagacaattccaagagcacactgtatctgcaaatgaacagcctgagaactgaagacacggctatatattactgt

SEQ ID NO: 5075 - DNA, 114 bp, Artificial Sequence
  Synthetic construct
tactatacagactccgtgaagggccgattcaccatctccagagacaattccaagaacacgctgtatctacaaatgaacagcctgagaactgcggacacggccgtgtattactgt

SEQ ID NO: 5076 - DNA, 114 bp, Artificial Sequence
  Synthetic construct
tactatgcagactccgtgaggggccgattcagcatctccagagacaattccaaaaacacactgtatctccaaatgaacagcctgagagctgaggacacggctgtatattactgt

SEQ ID NO: 5077 - DNA, 114 bp, Artificial Sequence
  Synthetic construct
tactacgcagactccgtgaagggccgattcaccatctccagagacaattccaagaacacactatatatgcaaatgaacagcctgagagctgaggacacggctgtctattactgt

SEQ ID NO: 5078 - DNA, 114 bp, Artificial Sequence
  Synthetic construct
tactacgcagaatccgtgaagggccgattcaccatctccagagacaattccaagaacactctctatctgcaaatgaacagcgtgaggcctgacgacacggctgtgtattactgt

SEQ ID NO: 5079 - DNA, 114 bp, Artificial Sequence
  Synthetic construct
tactacgcagactccgtgaagggccgattcaccatctccagagacaattccaagaacacgctgtatctgcaaatgaacagcctgagagctgaggacacggctgtgtattactat

SEQ ID NO: 5080 - DNA, 114 bp, Artificial Sequence
  Synthetic construct
tactatgcagactccgtgaagggccgattcaccatctccagagacaattccaagaacacactgtatctgcaaatgaacagcctgagagctgaggacacggctgtgtattactgt

SEQ ID NO: 5081 - DNA, 114 bp, Artificial Sequence
  Synthetic construct
tactatgcagactccgtgaagggccgattcaccatttccagagacaattccaagaacacgctgtatctgcaaatgaacagcctgagagctgaggacacggctgtgtattactgt

SEQ ID NO: 5082 - DNA, 114 bp, Artificial Sequence
  Synthetic construct
tactatgcagactccgtgaagggccgattcaccatctccagagacaattccaagaacacgctgtatctgcaaatgaacagcctgagagctgaggacacggctgtgtattactgt

SEQ ID NO: 5083 - DNA, 114 bp, Artificial Sequence
  Synthetic construct
tactacgcagactccgtgaagggccgattcaccatctccagagacacttccaacaacacgctgtatctgcaaatgaacagcctgagagctgaggacacggctgtgtattactgt

SEQ ID NO: 5084 - DNA, 114 bp, Artificial Sequence
  Synthetic construct
tactacgcagactccgtgaagggccgattcaccatctccagagacaattccaagaacacgctgtatctgcaaatgaacagcctgagagctgaggacacggctgtgtattactgt

SEQ ID NO: 5085 - DNA, 114 bp, Artificial Sequence
  Synthetic construct
tattatgcagactccgtgaagggccgattcaccatctccagagacaattccaagaacacgctgtatctgcaaatgaacagcctgagagctgaggacacggctgtgtataactgt

SEQ ID NO: 5086 - DNA, 114 bp, Artificial Sequence
  Synthetic construct
tactatgcagactccgtgaagggccgattcaccatctccagagacaattccaagaacacgctgtatctgcaaatgaacagcctgagagccgaggacacggctgtgtattactgt

SEQ ID NO: 5087 - DNA, 114 bp, Artificial Sequence
  Synthetic construct
aactacagagactccgtgaagggccgcttcaccgtttccagagacaattctaaggaaatgttgtttttacagatggattctatcagagccgacgacacggctatatattattgt

SEQ ID NO: 5088 - DNA, 114 bp, Artificial Sequence
  Synthetic construct
tactacgcagactccgtgaagggccgattcaccatctccagagacaactccaagaacacgctgtatctgcagatgaacagcctgagagctgaggacacggctgtcttttactgt

SEQ ID NO: 5089 - DNA, 114 bp, Artificial Sequence
  Synthetic construct
cattatgcagactccgttaagggccgattcaccatctccagagacaattccgagaacacggtgtatctgcaaatgaacagcctgagagctgaggacacgggtgtatatttctgt

SEQ ID NO: 5090 - DNA, 114 bp, Artificial Sequence
  Synthetic construct
ttctatgcagactccgttaagggccgattcaccatctccagagacaattccaagaccacaatatatctacaaatcaacagcctgagtgccgaggacacggctatgttttactgt

SEQ ID NO: 5091 - DNA, 114 bp, Artificial Sequence
  Synthetic construct
tactacgcagactccgtgaagggtcgatttacaatctctagagacaatttcaagaacacggtgtttctggaaatgaacaacctgagacctgaggaccaggctgtctattattgt

SEQ ID NO: 5092 - DNA, 114 bp, Artificial Sequence
  Synthetic construct
aactatgcagactccgtgaagggccgattcaccatctccagagacatttccgggaatacactgtatctgcaaatgaacagtctgagagttgaggacacggctgtttattactgt

SEQ ID NO: 5093 - DNA, 114 bp, Artificial Sequence
  Synthetic construct
tactacgcagattccgtgaagggccgattcaccatatccagagacaactctaaaaatacgatgtctctgcaaatgaacagtctgagaagtgaagatacggctttgtatttttgt

SEQ ID NO: 5094 - DNA, 114 bp, Artificial Sequence
  Synthetic construct
tactacgcagactccgtgaagggccgattcaccatctccagagacaattccaagaacacgttgtatctgcaaatgaacaacctgagagctgaggacacggctgtatattattgt

SEQ ID NO: 5095 - DNA, 114 bp, Artificial Sequence
  Synthetic construct
tcctttgcagactccgtgatggggcgatgcatcatctctagagacaattccgagaacaccctttttctgcaaatgcacagtctgagagttgaagatacggctctgtattactgc

SEQ ID NO: 5096 - DNA, 114 bp, Artificial Sequence
  Synthetic construct
cgttctgcagactccgtgaagggccgattcaccatttccagagacaattccaagaacacgctgtatctgcaaatgaacaacctgagacctgaagacacggctgtctattattgt

SEQ ID NO: 5097 - DNA, 114 bp, Artificial Sequence
  Synthetic construct
gcatatgctgcgtcggtgaaaggcaggttcaccatctccagagatgattcaaagaacacggcgtatctgcaaatgaacagcctgaaaaccgaggacacggccgtgtattactgt

SEQ ID NO: 5098 - DNA, 114 bp, Artificial Sequence
  Synthetic construct
ggctatgcggactctgtgaagggccgattcatcatctccagagacaacgccaagaactccctatatctgcaaatgaacagtctgagagctgaggacatggccgtgtattactgt

SEQ ID NO: 5099 - DNA, 114 bp, Artificial Sequence
  Synthetic construct
ggctatgcggactctgtgaagggccgcttcaccatctccagagacaacaccaagaactccctgtatctggaaatgaacagtctcagagttgaggacacggccttgtattactgt

SEQ ID NO: 5100 - DNA, 114 bp, Artificial Sequence
  Synthetic construct
gcctatgcggactctgtgaagggccgattcaccatctccagagaaaacgccaggaactccctgtatctgcaaatggacagtctgcgacctgaggacatggccttgtactactgt

SEQ ID NO: 5101 - DNA, 114 bp, Artificial Sequence
  Synthetic construct
ggctatgcggactctgtgaacggccgattcaccatctccagagacaacgccaagaactccctgtatctgcaaatgaacagtctgagagctgaggacatggccttgtattactgt

SEQ ID NO: 5102 - DNA, 114 bp, Artificial Sequence
  Synthetic construct
gcctatgcggactctgtgaagggccgattcaccatctccagagacagcgccaagaactccctgtctctgcaaatgaacagtctgagagctgaggacatggccttgtattactgt

SEQ ID NO: 5103 - DNA, 114 bp, Artificial Sequence
  Synthetic construct
gcctatgcggactctgtggagggccgattcaccatctccagagacaacgccaagaactccctgtatctgcaaatgaacagtctgagagctgaggacatggccttgtattactgt

SEQ ID NO: 5104 - DNA, 114 bp, Artificial Sequence
  Synthetic construct
aactatgcagactctgtgaagggtcgattcaccatctccagagacaacagcaaaaacttcctgtatctgcaaatgaacagtctgagagctgaggacagcgccttgtattattgt

SEQ ID NO: 5105 - DNA, 114 bp, Artificial Sequence
  Synthetic construct
tcctatgcagactctgtgaagggtcggttcaccatctccagagacaactccaaaaactccctctttctgcaaatgaacagtctgagagctgaggacaccgccctgtattattgt

SEQ ID NO: 5106 - DNA, 114 bp, Artificial Sequence
  Synthetic construct
ttctatggagactctgcgcagggtcgcttcagcgtctccagagacaacgacaaaaagttcctgtatctgcacatgaagagtctgagagctgaagacaccgccttcttttactgt

SEQ ID NO: 5107 - DNA, 114 bp, Artificial Sequence
  Synthetic construct
atatatgcagagaagttccagggcagagtcaccataaccgcagacacgtctacagacacagcctacatggagctgagcagcctgagatctgaggacacggccgtgtattactgt

SEQ ID NO: 5108 - DNA, 114 bp, Artificial Sequence
  Synthetic construct
aaatatgcagacaggtttcggggcagagtcaccatgaccgcagacacgtctacaaatacagcctacatggagttgagcagcctgagattggaagacacggccgtctattactgt

SEQ ID NO: 5109 - DNA, 114 bp, Artificial Sequence
  Synthetic construct
atttatgcagaaaagttctatggcagcgtcaccatgaccgccgacacgtctacacaaacaacatttttggagttgagcagtctgaagtttgcggacacggccgtttattactgt

SEQ ID NO: 5110 - DNA, 114 bp, Artificial Sequence
  Synthetic construct
tactacgcacagaagttccagggcagagtcaccatgaccagggacacgtccacgagcacagactatatggagatgagaagcctgagatctgaggacacggccgtgtattactgt

SEQ ID NO: 5111 - DNA, 114 bp, Artificial Sequence
  Synthetic construct
atctacgcacagaagctccaggacagagtctccctgaccagggacacgtccacgagcacaatgtacatggtactcaacagcctgagatctgaagacacggccgtctattattgt

SEQ ID NO: 5112 - DNA, 114 bp, Artificial Sequence
  Synthetic construct
agttacgcacacaggttccggggccgagtcaccatgaccagtgacacgtccacgagcacagtttacctggagctgaccagcctgacacctgaggacacggccgtgtattactgt

SEQ ID NO: 5113 - DNA, 114 bp, Artificial Sequence
  Synthetic construct
agctacgcacagaagttccagggcagagtcaccatgaccagggacacgtccacgagcacagtctacatggagctgagcagcctgagatctgaggacacggccgtgtattactgt

SEQ ID NO: 5114 - DNA, 114 bp, Artificial Sequence
  Synthetic construct
acctacgcacagaagttccagggcagagtcaccatgaccagggacacgtccacgagcacagtctacatggagctgagcagcctgagatctgaggacacggccgtgtattactgt

SEQ ID NO: 5115 - DNA, 114 bp, Artificial Sequence
  Synthetic construct
acctacgcccagaagttccagggcagagtcaccatgaccagggacacgtccgcgagcacagtgtccatggagctgagcagcctgagatctgaggacacggccgtatattactgt

SEQ ID NO: 5116 - DNA, 114 bp, Artificial Sequence
  Synthetic construct
aactatgcacagaagtttcagggcagggtcaccatgaccagggacacgtccatcagcacagcctacatggagctgagcaggctgagatctgacgacacggccgtgtattactgt

SEQ ID NO: 5117 - DNA, 114 bp, Artificial Sequence
  Synthetic construct
tactatgcagagaagtttcggggcagggtcaccctgaccagggacacgtccatcagtacagtctacatggaggtgggcaggctgagatctgacgacacggccgtctattactgt

SEQ ID NO: 5118 - DNA, 114 bp, Artificial Sequence
  Synthetic construct
aactatggtcagaaatttcaaggcagggtcaccatgaccagggacacgtccttcagcacagtttacatggatctgagcaggctgacatctgacgacacggccgtgtattactgt

SEQ ID NO: 5119 - DNA, 114 bp, Artificial Sequence
  Synthetic construct
aagtacgcacagaagttccggggcagagtcaccatgaccagggacacgtccaccagcacagtatacatggacctgagcagcctgagatctgacgacacggccgtgtattactgt

SEQ ID NO: 5120 - DNA, 114 bp, Artificial Sequence
  Synthetic construct
gccaacgaacagaagttccagggcagagtcaccatgaccagggacacgtccacgagcaccgtgtacatggagttgagcagcctgagatctgacgacacggccgtgttttactgt

SEQ ID NO: 5121 - DNA, 114 bp, Artificial Sequence
  Synthetic construct
atctacgcacagaagttccagggcagagtcaccatgaccgaggacacatctacagacacagcctacatggacctgagcagcctgagatctgaggacacggccgtgtattactgt

SEQ ID NO: 5122 - DNA, 114 bp, Artificial Sequence
  Synthetic construct
atctacgcacagaagttccagggcagagtcaccatgaccgaggacacatctacagacacagcctacatggagctgagcagcctgagatctgaggacacggccgtgtattactgt

SEQ ID NO: 5123 - DNA, 114 bp, Artificial Sequence
  Synthetic construct
aaatattcacagaagttccagggcagaatcacccttaccagggacacatccgcgagcacagcctacatggaattgaacagtctgacatctgaagacacggctgtctattactgt

SEQ ID NO: 5124 - DNA, 114 bp, Artificial Sequence
  Synthetic construct
aactacgcacagaagttccaggaaagagtcaccattaccagggacatgtccacaagcacagcctacatggagctgagcagcctgagatccgaggacacggccgtgtattactgt

SEQ ID NO: 5125 - DNA, 114 bp, Artificial Sequence
  Synthetic construct
ttttacgcagactccgtgaagggccgattcaccatctccagagacaactccaagaaaacgatgtatctgcaaatgaacagtctgagacttgaggacacggctgtttattactgt

SEQ ID NO: 5126 - DNA, 114 bp, Artificial Sequence
  Synthetic construct
aaatattcacagaagttccagggcagagtcaccattaccagggacacatccgcgagcacagcctacatggagctgagcagcctaaaatctgaagacacggctgtgtattattgt

SEQ ID NO: 5127 - DNA, 114 bp, Artificial Sequence
  Synthetic construct
aaatattcacagaagttccagggcagagtcaccattaccagggacacatccgcgagcacagcctacatggagctgagcagcctgagatctgaagacacggctgtgtattactgt

SEQ ID NO: 5128 - DNA, 114 bp, Artificial Sequence
  Synthetic construct
aaatattcacagaaattccagggcagagtcaccattaccagggccacatccgcgaccacagtctatttgggcctgaacagcctgacatctgaagacacggcactatattactgt

SEQ ID NO: 5129 - DNA, 114 bp, Artificial Sequence
  Synthetic construct
aaatattcacagaagttccagggcagaatcaccattagcagtgacacatccgcgagtacagtctacatggaactgagtagcctgagatctgaagacacggctgtgtattactgt

SEQ ID NO: 5130 - DNA, 114 bp, Artificial Sequence
  Synthetic construct
atgtatgcagcgagattccagggcagagtcaccataaccgcagacacatccacagacacaacgtacatgcagctgaccagcctgagatctgacgacacggccgtgtattattgt

SEQ ID NO: 5131 - DNA, 114 bp, Artificial Sequence
  Synthetic construct
tactactcagactcagtgaagggccgattcaccatctccagagacaacgccaagaattccctgcatctggacatggacagtctgagagtcgaggacacggctgtctattattgt

SEQ ID NO: 5132 - DNA, 114 bp, Artificial Sequence
  Synthetic construct
gaatacgccgcgtctgtggaaggcagattcaccatctcaagagatgaatcagagaactcgctgtatctgcaaatgaacaacctgagacccgaggacacggccatgtattattgt

SEQ ID NO: 5133 - DNA, 114 bp, Artificial Sequence
  Synthetic construct
ttttatgcagactccgtgaagggccgattcaccatatccagagacaattccaaggacacactttttctcgaaatgaacagcctgagagacgacgacacggctgtctactactgt

SEQ ID NO: 5134 - DNA, 114 bp, Artificial Sequence
  Synthetic construct
gactatgccgcgcctctgaaaggcagattcgtaatctcaagagatgattccaaaagtgtcgcctatcttcaaatcgacagcctgagcaccgacgacacaggcttctattattgt

SEQ ID NO: 5135 - DNA, 114 bp, Artificial Sequence
  Synthetic construct
tactacgcagactccgtgaagggccgattcaccatctccagagacaattcgaagaacactctctatcttcaaatggacagcctgagagtcgaggacacggccgtgtattactgt

SEQ ID NO: 5136 - DNA, 114 bp, Artificial Sequence
  Synthetic construct
ggatatgcagactcagtgaggggtcgattcaacatctccagagacgacgccaaaaattcattgtacctccacatgagcagcctgacaggcgacgacacggctgtctattactgt

SEQ ID NO: 5137 - DNA, 114 bp, Artificial Sequence
  Synthetic construct
gagtatggagactctgtgaagggccgattcaccgtctccagggacagcgccgagagtgcaatttttcttgaaatgaacaccctgagagtcgaggacacggctgtctatttctgt

SEQ ID NO: 5138 - DNA, 114 bp, Artificial Sequence
  Synthetic construct
ttctacgcagactctgtgaagggccgattcaccatctccagggacaacgccaagaactcactgtatctgcaaacgaacagcctgagagccgaggacacggctgtatattactgt

SEQ ID NO: 5139 - DNA, 114 bp, Artificial Sequence
  Synthetic construct
tactatgtggacgctgtgaagggccgaatcaccatctccagagacaatgccaagaactcactgtatctgcaaatgaacagcctgagagccgaggacacggctgtatattattgt

SEQ ID NO: 5140 - DNA, 114 bp, Artificial Sequence
  Synthetic construct
ttctatatagagtccgtgaggggccgcttcaccatctccagagacaattccaggaacacgatggatctgcagatgttgtcgttgagagtcgaggacacggccttatattattgt

SEQ ID NO: 5141 - DNA, 114 bp, Artificial Sequence
  Synthetic construct
tactacgcagactctgtgaagggccgattcaccatctccagagacaacgccaagaattcactgtatttgcaaatgaacagcctgagagtcgaggacacggctgtttattactgt

SEQ ID NO: 5142 - DNA, 114 bp, Artificial Sequence
  Synthetic construct
aactatgcagactcactgaagggccgattcaccatgtccagagacaatcccaagaagtccctgtatctgcaaatgaacagcctgagagccgaggacacgactgtgtgttgctgt

SEQ ID NO: 5143 - DNA, 114 bp, Artificial Sequence
  Synthetic construct
acctatgcggactccgtgaagggccgattctccatctccagagacaacgccaagaacacgctgtatttgcagttgaacagtctgagagccgaggacacggctgtatattactgt

SEQ ID NO: 5144 - DNA, 114 bp, Artificial Sequence; identical to SEQ ID NO: 1788
  Synthetic construct

SEQ ID NO: 5145 - DNA, 114 bp, Artificial Sequence
  Synthetic construct
tattacgcagactccgtgaaggacagattcatcatctccagagacaattccaagaacaccttgtatcttcaaatgaacagcctgagagtcgaggacacggctatgtatttctgt

SEQ ID NO: 5146 - DNA, 114 bp, Artificial Sequence
  Synthetic construct
tactttgcagcctcactgcggggccgctctaacatctccagagacgatcttaccaattcgctttttctggacataagtctcctgagagtcgaagatacggctacatattactgt

SEQ ID NO: 5147 - DNA, 114 bp, Artificial Sequence
  Synthetic construct
ttctacgcagactccgtcaagggccggttcaccatctccagagacaattccaacaacgcgctgtctctgcaaatgaacagcctgagagccgaggacacggccgtatattactgt

SEQ ID NO: 5148 - DNA, 114 bp, Artificial Sequence
  Synthetic construct
acctacgcagagaagtttcagggcagagtcacaattgccgcggacgcttccacgaacacagtctacatggagctcaggagcctgagatctgacgacacggccatgtattactgt

SEQ ID NO: 5149 - DNA, 114 bp, Artificial Sequence
  Synthetic construct
ggttatgcacagaagttccagggcagagtgatcttttctagggacacttcctcaaggacggcctatatggagatcagcagtctgacatccgacgacacggccctttatttttgc

SEQ ID NO: 5150 - DNA, 114 bp, Artificial Sequence
  Synthetic construct
aattccgcacagacgttgcacgccagagtcacgatcacgaccgacgagtccacgagcacagcctacatgcaactgagtagcctgacatctgaggacacggccgtctatttctgt

SEQ ID NO: 5151 - DNA, 114 bp, Artificial Sequence
  Synthetic construct
aactacgcaccgaatttcgaaaatagagtcacaattacacgagagttgtctaccgaaacagtgtttatggaattgagaagcctcacagccgacgacacggccatgtattattgt

SEQ ID NO: 5152 - DNA, 114 bp, Artificial Sequence
  Synthetic construct
aaatatgcagagaactttcagggcagagtctccctgaccgcagacacgtctacagacacagcctacatggaactgagcagcctgagatctgacgacacggccgtttattactgt

SEQ ID NO: 5153 - DNA, 114 bp, Artificial Sequence
  Synthetic construct
aaggttgcacggaagtttcagggcagggtcaccctgaccagggacacgtccatcagtacagtctacatggacctgagtaggctgcggtctgacgacacggccgtctattactgt

SEQ ID NO: 5154 - DNA, 114 bp, Artificial Sequence
  Synthetic construct
aactatgcacagaagttccaggacagggtcaccatgaccagggacacgtccatcagcacagcttacatggagttgagcaggctgagatctgacgacacggccgtgtattattgt

SEQ ID NO: 5155 - DNA, 114 bp, Artificial Sequence
  Synthetic construct
ctgtatgcagcgaagttccagggcagagtctccataaccgcagacacgtccacaaacacagcctacatggagctgagaagcctgagatctgaggacacggccgtattttactgt

SEQ ID NO: 5156 - DNA, 114 bp, Artificial Sequence
  Synthetic construct
aactatgcgcagaggtttcagggcagggtcaccttgaccagagacatgtccatcgggacagcctacatggaactgagcaggctgacatctgacgacacggccctttatttctgt

SEQ ID NO: 5157 - DNA, 114 bp, Artificial Sequence
  Synthetic construct
aagtctgcacagagttttcaggacagagtcaccgtgaccagggacacgtccatcaacacggcctacctggaactgaggaggttgagatctgacgacacggccgtttattactgc

SEQ ID NO: 5158 - DNA, 114 bp, Artificial Sequence
  Synthetic construct
agatattcaccgacatggcagggcagagtcacgtttgccagggacccaaccacgagtacggcctatatggaggtgaacagtctgacaacgtcagacacggctgtcttttattgt

SEQ ID NO: 5159 - DNA, 114 bp, Artificial Sequence
  Synthetic construct
tactacgcagactccgtgaagggccggttcaccatctccagagacaattccaaggacaccttgtatctgcaaatgaacagcctgcgagccgaggacacggccgtatactactgt

SEQ ID NO: 5160 - DNA, 114 bp, Artificial Sequence; identical to SEQ ID NO: 1791
  Synthetic construct

SEQ ID NO: 5161 - DNA, 114 bp, Artificial Sequence
  Synthetic construct
atatctgcagagaagttccagggcagagtcaccataaccgcagacacgtctacagacacagccttcatggacctgagtagcctgagatctgaggacacggccgtgtattactgt

SEQ ID NO: 5162 - DNA, 114 bp, Artificial Sequence
  Synthetic construct
gactacgcagactccgtgaagggccgattcaccatttcaaaagacaatatgaggaacacactgtatttgcaactaaatagcctgagacctgaggacacggctgtctttttctgt

SEQ ID NO: 5163 - DNA, 114 bp, Artificial Sequence
  Synthetic construct
gactacgcacagaagtttcagggcagggtcacgatcaccacggacgaagacacgagcactgcctacttggttttgaccagtctgacatcagaagacacggccgtatatttctgt

SEQ ID NO: 5164 - DNA, 114 bp, Artificial Sequence
  Synthetic construct
aactacgcacagaagttccaggacagagtcacaattaccgcggacatgtccacgagtacagcctacatggaaattagtggcctgacatctgaggacacggccatctattactgt

SEQ ID NO: 5165 - DNA, 114 bp, Artificial Sequence
  Synthetic construct
gacatcgctcaggcattccaagacagagtcactcttaccagggacgaatctaagaatacagcctacatggaactgagcaacctgagatctggggacacggccatttattactgt

SEQ ID NO: 5166 - DNA, 114 bp, Artificial Sequence
  Synthetic construct
aattacgcacaaaagttcaagggcagagtcacgattagtgcggacgactccccgagtgcagcctacttggagctgagcagcctgacacctgaagacacggccatttattactgt

SEQ ID NO: 5167 - DNA, 114 bp, Artificial Sequence
  Synthetic construct
tacttcgcaaactcagtgaagggccgaatcaccatctccagagacaactccaagaactcactgtttctgcaaatcaacagcctgcgagacgaggacacggctacttattactgt

SEQ ID NO: 5168 - DNA, 114 bp, Artificial Sequence
  Synthetic construct
tactacgcagactctgtgaagggccgattcaccatctccagagacaactccaagagctcactgtatctgcaaatgaacagcctgagagtcgaggacacggctgtttattattgt

SEQ ID NO: 5169 - DNA, 114 bp, Artificial Sequence
  Synthetic construct
acgtatgcccagggcttcccaggacggtttgtcttctccttggacacctctgtcagcacgacatatctgcagatcagcagcctaaaggctgaggacactgccatgtatttctgt

SEQ ID NO: 5170 - DNA, 114 bp, Artificial Sequence
  Synthetic construct
tcctatgtggactctgtgctgggccgattcaccatctccagagacaacgccaagaactcactgtatcttcacgtgagcagcctgagagtcgaggacacggcaatgtattactgt

SEQ ID NO: 5171 - DNA, 114 bp, Artificial Sequence
  Synthetic construct
tattatgcagactccgtgaagggccggttcaccatctccagagacaattccaagaacatgatatatctggaaatgaacagcctgcgagccgacgacacggccctatattactgt

SEQ ID NO: 5172 - DNA, 114 bp, Artificial Sequence
  Synthetic construct
caccttctggactctgtgaagggccgattcaccatctccagagacaacgccaagaactcagtgtatctgcaaatgaacagcctgagaggcgaggacacgggaatgtattactgt

SEQ ID NO: 5173 - DNA, 114 bp, Artificial Sequence
  Synthetic construct
gaatatgccgcgtctgtgaaaggcagaagtaacatcacaagagatgattccagaaacatcgtctatttatatgtggacagcctgaaaatggaggacacggccgtctattattgt

SEQ ID NO: 5174 - DNA, 114 bp, Artificial Sequence; identical to SEQ ID NO: 1787
  Synthetic construct

SEQ ID NO: 5175 - DNA, 114 bp, Artificial Sequence
  Synthetic construct
gactacgctgcagccgtgagaggcagattcaccatctcaagagacgattcaaaaaaaactctctatctgcaaatgaatagactgaagatggaggacaccgccgtgtattactgc

SEQ ID NO: 5176 - DNA, 114 bp, Artificial Sequence
  Synthetic construct
gactacgccgcgtctctgaaaggcagattcaccattacaagagatgatcccaaaaacatcacctatctacaaatgaacagcctgacaaccgaggacacagccgtctattattgt

SEQ ID NO: 5177 - DNA, 114 bp, Artificial Sequence
  Synthetic construct
gcctacgcacagaagttccagggcagagtcgccatggccagggacacgtccacgaccacattctacgtggagttgagcagtctgacatctgacgacacggccttatatttctgt

SEQ ID NO: 5178 - DNA, 114 bp, Artificial Sequence
  Synthetic construct
aactacgcagcctccgtgaatgggcgattcaccatctccagagacaactccaagaacacgttatatctccaaatgaacagcctgagacctgaagacacggctgtttattactgt

SEQ ID NO: 5179 - DNA, 114 bp, Artificial Sequence
  Synthetic construct
atttacagtccatctctgagtaacagactcaccatcaccaaggacacctccagacaccaagtggtcctcacattgaccgacgtgggccctgttgacacagccacatacttctgt

SEQ ID NO: 5180 - DNA, 114 bp, Artificial Sequence
  Synthetic construct
aagtatgcacagaacttccagggcagaatgaatgtgaccatagacacacccacgagcacagcctacatggagctgaggagcctgaaatctgacgacacggccgtgtattactgt

SEQ ID NO: 5181 - DNA, 114 bp, Artificial Sequence
  Synthetic construct
tattacgcagactccgtgaagggccgattcaccttcgccacagacatttccaagaacaccttttatctgcaaatgaaccgcctgcgagttgaggacacggctatatattactgt

SEQ ID NO: 5182 - DNA, 114 bp, Artificial Sequence
  Synthetic construct
caatattcgcagaatttacaaggcagagtcaccattaccagggacacatccgcgagcacggttgacatggaactgaggagcctgacatctgtagacacggctgtgtattactgt

SEQ ID NO: 5183 - DNA, 114 bp, Artificial Sequence
  Synthetic construct
gtctcttcacagaagttccagggcagagtcacctttagcgtgaacacctccttgaatacagcctacatggcgctgagcagcctcacatctgaagacacggccgtctactactgt

SEQ ID NO: 5184 - DNA, 114 bp, Artificial Sequence
  Synthetic construct
aattatgcacggatgttccagggcagagtcacgattaccgcggacgaatcgtcgaaaactgcctacatggagttgaaacgcctgacatctgaggacacggccgtctattactgt

SEQ ID NO: 5185 - DNA, 114 bp, Artificial Sequence
  Synthetic construct
gacatcgcacagaagttccgtgacagagtcactttttccgcggacccatcgacaggaactgtctacatggagctgactgacctcagatttggggacacggccacctactactgt

SEQ ID NO: 5186 - DNA, 114 bp, Artificial Sequence
  Synthetic construct
aactacgcacagaaattccagggcagagtcacaattagcgcggacgaatctacgaacacagtttacatggacctgagcagcctgagatctgaagacacggccatgtattactgt

SEQ ID NO: 5187 - DNA, 114 bp, Artificial Sequence
  Synthetic construct
aagtacgcacagaagttccaggacagagtcacaattacatcggacgaatcctcgaccactgcctacctagacctgcgcaacctgacatctgaagacacggccgtctattactgt

SEQ ID NO: 5188 - DNA, 114 bp, Artificial Sequence
  Synthetic construct
tcctacagtacatctctgaagaccagactcactatctccaaggacacctccaaaagtcaggtggtccttatcatgaccaatttggaccctgtggacacagccacatattactgt

SEQ ID NO: 5189 - DNA, 114 bp, Artificial Sequence
  Synthetic construct
tactacagcacatctctgaagaccaggctcaccatctccaaggacacctccaaaaaccaggtggtcctttcaatgaccaacatggaccctgtggacacagccacgtattactgt

SEQ ID NO: 5190 - DNA, 114 bp, Artificial Sequence
  Synthetic construct
aactacgcagcgcacttcaaagacagattgaagatgaccacggacgagtccacaaacaccgccttcatggaactgagcaatctgacttctgacgacacggccacatactactgc

SEQ ID NO: 5191 - DNA, 114 bp, Artificial Sequence
  Synthetic construct
aaatattcacagaggctcgagggcagagtcaccatgaccacagacacatccacgaacacagcctacatggagctgaggaggctgagatctgacgacacggccgtttattactgt

SEQ ID NO: 5192 - DNA, 114 bp, Artificial Sequence
  Synthetic construct
agatacagcccgtccttccgaggccaggtcattatttcagccgacaagtccgtcgagaccgcctacctgcagtggagcagcctgaagtcctcggacactgccatctattactgt

SEQ ID NO: 5193 - DNA, 114 bp, Artificial Sequence
  Synthetic construct
agatatagcccgtccttccaaggccaggtcaccatctcagccgacaagtccatcaacaccgcctacctacagtggagtagcctgaaggcctcggacaccgccatgtattattgt

SEQ ID NO: 5194 - DNA, 114 bp, Artificial Sequence
  Synthetic construct
aactacaccccgtcgctcaagagtcgagtcaccatttcactagacacatccaagaatctggtgtccctgaggttgcggtctgtgaccgccgcggacacggctctttataactgt

SEQ ID NO: 5195 - DNA, 114 bp, Artificial Sequence
  Synthetic construct
ttctatgaagactccgtgaagggccgattcatcatatccagacacagttccaagaacatcgtgtatcttcaaatgaacaccctgatacttcaggacgcggccgtctatttttgt

SEQ ID NO: 5196 - DNA, 114 bp, Artificial Sequence
  Synthetic construct
gaatacgccgagtctgtgaaaggcagattcaccatctcaagagatgattccaaaagtatcgcctatctacaaatgaacagcctgaagaccgaggacacagccgtgtattactgt

SEQ ID NO: 5197 - DNA, 114 bp, Artificial Sequence
  Synthetic construct
ttttacaagacatctctgaagaccagactcaacatctccaaggacacctccaaaaaccaggtggtccttacaatgatcaacatggaccccgtggacacagccacatattattgt

SEQ ID NO: 5198 - DNA, 114 bp, Artificial Sequence
  Synthetic construct
tactacagcacatctctgaagaccaggctcaccatctccaaggacacctccagtaaccaggtggtccttacaatgaccaccatggaccctgtggacacagccacgtatttctgt

SEQ ID NO: 5199 - DNA, 114 bp, Artificial Sequence
  Synthetic construct
tcctacagcacatctctgaagagcaggctcaccatctccaaggacccctccaaaagccaggtggtccttaccatgaccaatctggaccctgtggacacagccacatattactgt

SEQ ID NO: 5200 - DNA, 114 bp, Artificial Sequence
  Synthetic construct
ttttacaactcatctctgaggtccagactcaccatctccaaggacacctccaaaagccaagttgtccttacactgaccaacatggaccctgtggacacaggcacctatttctgt

SEQ ID NO: 5201 - DNA, 114 bp, Artificial Sequence
  Synthetic construct
ttctatagcacatctctgaagaccaggctcaccatctccaaggacacctccaaaaaccaggtggtccttacaatgaccaacatggaccctgtggacacagccacgtattactgc

SEQ ID NO: 5202 - DNA, 114 bp, Artificial Sequence
  Synthetic construct
ttctacagcacatctctgaagaccaggctcaccatctccaaggacacctccaaaaaccaggtggtccttacaatgaccaacatggaccctgtggacacagccacgtattactgt

SEQ ID NO: 5203 - DNA, 114 bp, Artificial Sequence
  Synthetic construct
tactacagtacatctctgaagaccaggctcaccatctccaaggacacctccaaaaaccaggtggtccttacaatgaccaacatggaccctgtggacacagccacgtattactgt

SEQ ID NO: 5204 - DNA, 114 bp, Artificial Sequence
  Synthetic construct
tcctacaggccgtccctgaagagtcggctcaccatctcccaggacacctccaagaaccaggtgttccttaatatgaccaatgtggaccctggggacacagccacttactattgt

SEQ ID NO: 5205 - DNA, 114 bp, Artificial Sequence
  Synthetic construct
gaatacgccgcgtctgtgcggcgcagattcaccatctcaagagatgattccaaaaacatcgtctatctgcaaatgaacagcctgagaaccgaggacacaggcgtctattactgt

SEQ ID NO: 5206 - DNA, 114 bp, Artificial Sequence
  Synthetic construct
tactacagcacatctctgaagaccaggctcaccatctccaaggacacctcaacaaaccgggtggtcctgacaatgaccaacatggaccctgtggacacagccacttattactgt

SEQ ID NO: 5207 - DNA, 114 bp, Artificial Sequence
  Synthetic construct
tattacagagactctgtgagggggcgcttcaccgtgtcccgagacaactccaaaaatacagtgtttctgcaaatggacaacctgggagtcgacgacacgggcatttacttctgt

SEQ ID NO: 5208 - DNA, 114 bp, Artificial Sequence
  Synthetic construct
ttttacagcacatctctgaaggccaggctcaccgtctccaaggacacctccaaaaaccaggtggtcctcacaatgaccaacatggaccctatagacacagccacgtattactgt

SEQ ID NO: 5209 - DNA, 114 bp, Artificial Sequence
  Synthetic construct
cgctacaggccatctctgaagagcagactcaccatcaccaaggacacctccaaaaaccaggtggtccttacaatgaccaacgtggaccctgtggacacagccacatatttctgt

SEQ ID NO: 5210 - DNA, 114 bp, Artificial Sequence
  Synthetic construct
aggaagaggccgtctctggagaccagggtcaccatcaccaaggacaccgccaaaaaccaggtggtctttacactgaccgacatggaccctgtggacacaggcacctattactgt

SEQ ID NO: 5211 - DNA, 114 bp, Artificial Sequence
  Synthetic construct
cgctacagcccatctctgaagaccagactcaccatcaccaaggacacctccacaaaccaggtggtccttacattgatcaacatggaccctgtggacacagccacatattactgc

SEQ ID NO: 5212 - DNA, 114 bp, Artificial Sequence
  Synthetic construct
cgctacagcccatctctgaagagcaggctcaccatcaccaaggacacctccaaaaaccaggtgttccttacaatgaccaacatggaccctgtggacacagccacatattactgt

SEQ ID NO: 5213 - DNA, 114 bp, Artificial Sequence
  Synthetic construct
cgctacagcccatctctgaagaacagactcagcatcaccaaggacacctccaaaaatcaggtggtccttacaatgaccaacgtggaccctgtggacacagccacatattactgt

SEQ ID NO: 5214 - DNA, 114 bp, Artificial Sequence
  Synthetic construct
cgatacagtccgtctctgagggccaggctcaccgtcacgaaggacacctccaaaaaccaggtggtctttagaatgataaacatggaccctgtggacacagccacatatttctgt

SEQ ID NO: 5215 - DNA, 114 bp, Artificial Sequence
  Synthetic construct
cgttacagcccatctctgaagagcaggctcaccatcaccaaggacacctccaaaaaccaggtggtccttacaatgaccaacatggaccctgtggacacagccagatattactgt

SEQ ID NO: 5216 - DNA, 114 bp, Artificial Sequence
  Synthetic construct
tggtacagcccatctttgaagagcaggctcaccatcaccaaggacacctccaaaaaccaggtggtccttacaatgaccaacatggaccctgtggacacagcaacatattactgt

SEQ ID NO: 5217 - DNA, 114 bp, Artificial Sequence
  Synthetic construct
gtttacgctgactccgtgaagggccggttcaccctctccagagacaattccgagaacacgttgtctctgcaaatgaacagcctgagagtcgaggacacggccctatattactgt

SEQ ID NO: 5218 - DNA, 114 bp, Artificial Sequence
  Synthetic construct
aactacgcagattctgtgaagggccgattcaccatctccagagacaacgccaagaattccgtgtatttgcagctgagcagtctgagagtcgaggatacggctgtttattactgt

SEQ ID NO: 5219 - DNA, 114 bp, Artificial Sequence
  Synthetic construct
gactacaacccctccctcaagagtcgagtcaccatatcagtagacacgtccaagaaccagttctccctggagctgagctctgtgaccgccgcagacacggccatgtattactgt

SEQ ID NO: 5220 - DNA, 114 bp, Artificial Sequence
  Synthetic construct
gattatgcagtatctgtgaaaagtcgaataaccatcaacccagacacatccaagaaccagttctccctgcagctgaactctgtgactcccgaggacacggctgtgtattactgt

SEQ ID NO: 5221 - DNA, 114 bp, Artificial Sequence
  Synthetic construct
tactacaacccgtccctcaagagtcgaatttccatatcagcagacacggccaagaaccagttctccctggaggtgaagtctgtgaccgccgcggacacggccgtgtattactgc

SEQ ID NO: 5222 - DNA, 114 bp, Artificial Sequence
  Synthetic construct
aattacaatccctccctccagagtcgagccaccatatcactagacacgaccaacaaccagttctccctgaagttgagctctgtgaccgctgcggacacggccgtatattactgt

SEQ ID NO: 5223 - DNA, 114 bp, Artificial Sequence
  Synthetic construct
aagtataacccgtcactcaagagtcgagtcagcatttcagtagacacgtccaagaggcagatctccctcaaagtgatttctgtgaccgccgcggacacggctatatattattgt

SEQ ID NO: 5224 - DNA, 114 bp, Artificial Sequence
  Synthetic construct
agctacgacccctccctcaagagtcgagtctccatgtcagtagacacgtccaggaatcagttctccctgaaactgacctctgtgaccgctgctgacacggccgtttattactgt

SEQ ID NO: 5225 - DNA, 114 bp, Artificial Sequence
  Synthetic construct
aagtacggcccctccctcaagagtcgagtcaccatgtcagtagacacttccaagaaccagttctccctgacactgacctctgtgaccgctgcggacacggccatatattactgt

SEQ ID NO: 5226 - DNA, 114 bp, Artificial Sequence
  Synthetic construct
aactacaatccctccctcaagaggcgagtctccatatcagtagacacataccagaaccaattctccctgaaactgagttctgtgaccgccgcagacacggccgtatattactgt

SEQ ID NO: 5227 - DNA, 114 bp, Artificial Sequence
  Synthetic construct
aattacaacccttccctcacgagtcgagtctccatgtcaatagagacgtccaagaaccagttctccttgaggctgacctctgtgaccgccgcagacacggccgtatatttctgt

SEQ ID NO: 5228 - DNA, 114 bp, Artificial Sequence
  Synthetic construct
aactacagcccctccctcttgagtcgagtcaccatatcagtggacacgtccaggaaccacctctccctgaggctgagctctgtgaccgccgcagacacggccgtgtattactgt

SEQ ID NO: 5229 - DNA, 114 bp, Artificial Sequence
  Synthetic construct
gaatacaacccctccctcaagagtcgagtcaccatatcagtagacccgtccaagaaccacttctctttgaagctgacctctgtgaccgcctcagacacggccgtgtattactgt

SEQ ID NO: 5230 - DNA, 114 bp, Artificial Sequence
  Synthetic construct
tactacaacccctccctcaggagtcgagtcaccatgtcagttgacacgtccaagaatcagttctccctgaatctgagttctgtgaccgctgcggacacggccgtctattactgt

SEQ ID NO: 5231 - DNA, 114 bp, Artificial Sequence
  Synthetic construct
aactacaacccctccctcaagagtcgagtcgccatatcagtagacacgtccaggagccagttttccctgaaacttacttctgtgaccgctgcggacacggccgtgtatttctgt

SEQ ID NO: 5232 - DNA, 114 bp, Artificial Sequence
  Synthetic construct
aactacaacccctccctcaagagtcgagtctccatatcactggacgagtccaggaaccagttctccctgaagctgacctctatgaccgctgcggacacggccatatattattgt

SEQ ID NO: 5233 - DNA, 114 bp, Artificial Sequence
  Synthetic construct
aattacaactccgccctcaagagtcgagtctccatgtccctggacacgtccaagaaccagttctccctgaggctgacgtctgtgaccgctgcggacacggccgtctactactgt

SEQ ID NO: 5234 - DNA, 111 bp, Artificial Sequence
  Synthetic construct
tacaacccgtccctcaagagtcgagtcaccatatcaatagacacgtccaagaaccaggtctccctgaaattgagctctgtgaacgccgcggacacggctgtgtattactgt

SEQ ID NO: 5235 - DNA, 114 bp, Artificial Sequence
  Synthetic construct
aactacaacccctccctcaagagtcgagtcaccatatcaatagacacgtccaagaaccagttctccctgaagctgagctctgtgaccgctgcggacacggccgtgtattactgt

SEQ ID NO: 5236 - DNA, 114 bp, Artificial Sequence
  Synthetic construct
aactacaatccctccctcaagagtcgagtcaccatagcagtagacacgtccaagaaccagttctccctgaagctgacctctgtgaccgctgcggacacggccgtgtattactgt

SEQ ID NO: 5237 - DNA, 114 bp, Artificial Sequence
  Synthetic construct
aactacaacccctcactcaagggtcgagtcaccttatcagtagacacgtccaagaaccagttctccctgaagctgagctctgtgaccgctgcggacacggccgtgtattactgt

SEQ ID NO: 5238 - DNA, 114 bp, Artificial Sequence
  Synthetic construct
acctacaattcctccctcaggagtcgagtcaccatgtcagtagacacgtccaagaaccagttctccctgaagctgacctctgtgaccgccgcggacacggccgtctattactgt

SEQ ID NO: 5239 - DNA, 114 bp, Artificial Sequence
  Synthetic construct
tcctataacccgtccctcacgagtcgagtcagtctgtcactagataagtccaagaaccagttctccctggatctgacctctgtgaccgcctctgacacgggcgtctattactgc

SEQ ID NO: 5240 - DNA, 114 bp, Artificial Sequence
  Synthetic construct
aactataacccctccctcaagagtcgagtcaccatatcagtagacacgtccaagaaccagttctccctgaagctgagctctgtgaccgccgcagacacggccgtgtattactgt

SEQ ID NO: 5241 - DNA, 114 bp, Artificial Sequence
  Synthetic construct
aattacaacccctccctcaggagtcgagtcaccatatcaatagataggtccaagagccagttctccctgaagttaaactctgtgaccgccgcggacacggccgtgtatttctgt

SEQ ID NO: 5242 - DNA, 114 bp, Artificial Sequence
  Synthetic construct
aactacaattcctccctcaagagtcgagtcaccatatcactagacacgtccaagagccagttctccctgaagctgaggtctctgaccgccgcagacacggccgtctattactgt

SEQ ID NO: 5243 - DNA, 114 bp, Artificial Sequence
  Synthetic construct
aactccaacccctccctccggagtcgagtcaccatatcactagacgagtccgggaaccagttttccctgaggttaaactctgcgaccgctgcggacgcggccatttattactgt

SEQ ID NO: 5244 - DNA, 114 bp, Artificial Sequence
  Synthetic construct
cagtacaacccctccctccagagtcgagtcaccctttcagtagacacgtccaagaaccagttctccctgcagctgagctctgtgaccgccgcagacacggccgtgtattactgt

SEQ ID NO: 5245 - DNA, 114 bp, Artificial Sequence
  Synthetic construct
acctacagcccgtcccccaagagccgagtcaccgtatcagcagacacgtccaagaatcagttctccctgaagctgagttctgtgaccgccgcagacacggccgtgtattactgt

SEQ ID NO: 5246 - DNA, 114 bp, Artificial Sequence
  Synthetic construct
cactacaatccctccctgaagaatcgggcctccgtgtcactggacacctccaggaattcattttccttgcgcctgacgtcagtgaccgccgcagactcggccatttattactgc

SEQ ID NO: 5247 - DNA, 114 bp, Artificial Sequence
  Synthetic construct
cacgacaacccgtccctccagagtcgagtcaccatgtcagtggacacgtacaagcagcaattctccctgacactgacgtctctgaccgccgcggacacggctgtctactactgt

SEQ ID NO: 5248 - DNA, 114 bp, Artificial Sequence
  Synthetic construct
aactacaggccgtcgctcaagagtcgagtcatcatatcaggagacacgtccaagaagcagttctccctgaggctgccctctgtgaccgccgcggacacggctgtatattactgt

SEQ ID NO: 5249 - DNA, 114 bp, Artificial Sequence
  Synthetic construct
aactacaacccgtccctcaagagccgagtcaccatatcagcagacacgtccaagaaccagttctccctgacattgaggtctgtgaccgccgcggacacggcgatgtattactgt

SEQ ID NO: 5250 - DNA, 114 bp, Artificial Sequence
  Synthetic construct
aactacaacccgtccctcaagagtcgagtcaccatatcagtagacacgtccaagaaccagttctccctgaagctgagctctgtgaccgccgcggacacggctgtgtattactgt

SEQ ID NO: 5251 - DNA, 114 bp, Artificial Sequence
  Synthetic construct
aactacagcccgtccctcaagagtcgagtcaccatatcagtagacacgtccaaaaaccagttctccctgaagctgagctctgtgaccgccgcggacacggctgtgtattactgt

SEQ ID NO: 5252 - DNA, 114 bp, Artificial Sequence
  Synthetic construct
aactacaacccgtccctcaagagtcgagtcaccatatcactagacacgtccaagaaccagttctccctgaagctgagctctgtgaccgccgcggacacggctgtgtattactgt

SEQ ID NO: 5253 - DNA, 114 bp, Artificial Sequence
  Synthetic construct
aactacatcccgtccctcaagagtcgagtcaccatatcagtagacacgtccaagaaccagttctccctgaagctgagctctgtgaccgccgcggacacggctgtgtattactgt

SEQ ID NO: 5254 - DNA, 114 bp, Artificial Sequence
  Synthetic construct
aactacaatccgtccctcaagaatcgagtcaccatctcactagacaagtccaagaaccaattctccctcaaaatgacctctgtgaccgccgcggacacggctatctattactgt

SEQ ID NO: 5255 - DNA, 114 bp, Artificial Sequence
  Synthetic construct
aaatacaacccgtccctcaagagtcgagtcaccacttcagtagacacgtctaagaatcaattctccctgaaactgaggtctctgaccgccgcggacacggctgtttattactgt

SEQ ID NO: 5256 - DNA, 114 bp, Artificial Sequence
  Synthetic construct
aactacaacccgtccctccagagtcgagtcaccatatcagcagacacgtccaagagccaattctccctgaatctgaggtctgtgaccgccgcggacacggctgtttattactgt

SEQ ID NO: 5257 - DNA, 114 bp, Artificial Sequence
  Synthetic construct
aactccaacccgtccctcaagagtcgagtcaccatgtcagtagacacgtccaagaaccagttctccctgaagctgagctctgtgaccgccgcggacacggctgtctattactgt

SEQ ID NO: 5258 - DNA, 114 bp, Artificial Sequence
  Synthetic construct
aattacaacccgtccctcaagagtcgagtcaccatttcagtcgacacgtccaagaatcagttctccctgaagttgacttctgtcaccgccgcggacacggctgtttattattgt

SEQ ID NO: 5259 - DNA, 114 bp, Artificial Sequence
  Synthetic construct
aactacaacccctccctcaagagtcgagtcaccatttcattagacacgtccaggaaccagttctccctgaggctgaggtctgtgaccgctgcggacacggccgtctattactgt

SEQ ID NO: 5260 - DNA, 114 bp, Artificial Sequence
  Synthetic construct
gactacaacccgtccctcaagagtcgagttaccatatcaggagacacgtccaggaaccagttctccctgaagctgacctctgtgaccgccgcggacacggccgtgtattactgt

SEQ ID NO: 5261 - DNA, 114 bp, Artificial Sequence
  Synthetic construct
tactacaacccgtccctcaagagtcgagtcaccatatcagtagacaggtccaagaaccagttctccctgaagctgagctctgtgaccgccgcggacacggccgtgtattattgt

SEQ ID NO: 5262 - DNA, 114 bp, Artificial Sequence
  Synthetic construct
tattacaacccgtccctcaagagtcgatttaccatgtcaatagacacggccaagaatcagttctccctgaacctgaactctgtgaccgccgcggacacggccgtctattactgt

SEQ ID NO: 5263 - DNA, 114 bp, Artificial Sequence
  Synthetic construct
gactacagcccctccctcaagagtcgagccaccatatcaattgacccatcgaagagtcagtttttcctgaagttgaggtctgtgaccgccgctgacacggccgtatattactgt

SEQ ID NO: 5264 - DNA, 114 bp, Artificial Sequence
  Synthetic construct
aagtacaacccctccctcaagagtcgaggcaccatatcagtagacacgtccaaaaaccagttctccctgaagctgagctctgtgaccgctgcggacacggccgtgtatttctgt

SEQ ID NO: 5265 - DNA, 114 bp, Artificial Sequence
  Synthetic construct
aagtacgacccctccctcacgagtcgagtcaccatatcagtggacacgtccaagaaccagattaccctgaacctgacctctgtgaccgccgcggacacggccgtgtattattgt

SEQ ID NO: 5266 - DNA, 114 bp, Artificial Sequence
  Synthetic construct
aactacaacccctccctcaagagtcgagtcaccatttcattagacacgtccaacaaccagttctccctgaagctgagctctgtgaccgccgcagacacggccgtttattactgt

SEQ ID NO: 5267 - DNA, 114 bp, Artificial Sequence
  Synthetic construct
aactacaacccctccctcaagagtcgagtcaccatatcagtagacacgtccaagaaccagttctccctgaagctgagctctgtgaccgccgcagacacggccgtgtattactgt

SEQ ID NO: 5268 - DNA, 114 bp, Artificial Sequence
  Synthetic construct
aactacaacccctccctcaagagtcgagtcaccatatcagtagacacgtccaagaaccagttctccctgaagctgagctctgtgaccgctgcggacacggccgtgtattactgt

SEQ ID NO: 5269 - DNA, 114 bp, Artificial Sequence
  Synthetic construct
gactacaacccctccctcaagagtcgagtcaccatatcagtagacacgtccaagaaccagttctccctgaagctgagctctgtgaccgctgcggacacggccgtgtattactgt

SEQ ID NO: 5270 - DNA, 114 bp, Artificial Sequence
  Synthetic construct
aactataacccctccctcaagagtcgagtcaccatatcagtagacacgtccaagaaccagttctccctgaagctgagctctgtgaccgctgcggacacggccgtgtattactgt

SEQ ID NO: 5271 - DNA, 114 bp, Artificial Sequence
  Synthetic construct
aactacaacccctccctcaagaatcgattcaccatatcagtagacacgtccaagaaccagttctccctgaaggtgacctctgtgaccgccgcagacacggccgtgtattactgt

SEQ ID NO: 5272 - DNA, 114 bp, Artificial Sequence
  Synthetic construct
aagtacaacccctccctcaagagtcgagtcaccatatcagtagacacgtccaagaaccagttctccctgattctgagctctgtgaccgctgcggacacggccgtgtattattgt

SEQ ID NO: 5273 - DNA, 114 bp, Artificial Sequence
  Synthetic construct
aactacaacccctccctcaagagtcgagtcaccatttcagtagacacgtccaaaaaccagttctccctgaggctgacctctgtgaccgctgcggacacggccgtgtattattgt

SEQ ID NO: 5274 - DNA, 114 bp, Artificial Sequence
  Synthetic construct
aactacaatccctccctcaagagtcgagtcaccatatcagtagacatgtccaagaaccagttctccctgaagatgagctctgtgaccgccgaagacacggccgtgtattattgt

SEQ ID NO: 5275 - DNA, 114 bp, Artificial Sequence
  Synthetic construct
gaccacaacccctccctcaagaggggagtcaccatatcagtggacacgtccaagaaccagttctccttgaggctgacttctgtgaccgccgcagacacggccgtctattactgt

SEQ ID NO: 5276 - DNA, 114 bp, Artificial Sequence
  Synthetic construct
aactacaacccctccctcaagagtcgagtcaccatatcagtagacacgtccaagaaccagttctccctgaggctgacctctgtgaccgccgcagacacggccgtgtattactgt

SEQ ID NO: 5277 - DNA, 114 bp, Artificial Sequence
  Synthetic construct
aactacaacccctccctcaagagtcgagtcaccatatcaatagacacgtccaagaaccagttctccctgaagatgagctctgtgaccgccgcagacacggccgtgtattactgt

SEQ ID NO: 5278 - DNA, 114 bp, Artificial Sequence
  Synthetic construct
aactacaacccctccctcaagagtcgagtcaccatatcagtagacacgtccaagaaccacttctccctgaagctgagctctgtgaccgccgcagacacggccgtctattactgt

SEQ ID NO: 5279 - DNA, 114 bp, Artificial Sequence
  Synthetic construct
aactacaacccctccctcaagagtcgagtcaccatgtcagtagacacgtccaagaaccagttctccctgaagctgagctctgtgaccgccgcggacacggccgtgtatttctgt

SEQ ID NO: 5280 - DNA, 114 bp, Artificial Sequence
  Synthetic construct
gactacaacccctccctttcaaatcgagtcaccatgtcggtggacacgtccaagaatcagttctccctgacggtggactctgtgaccgcagcagacacggccgtctatttctgt

SEQ ID NO: 5281 - DNA, 114 bp, Artificial Sequence
  Synthetic construct
aactacaacccctccctcaagagtcgagtcaccatatcagtagacacgtccaacaataagttctccctgaagctgagctctgtgaccgctgcggacacggccgtttattattgt

SEQ ID NO: 5282 - DNA, 114 bp, Artificial Sequence
  Synthetic construct
aactacaacccctccctcaagagtcgagtcaccatttcagtggactcgtccaagagccagttgtccctgaggctgagctctgtgaccgctgaggacacggccatatattactgt

SEQ ID NO: 5283 - DNA, 114 bp, Artificial Sequence
  Synthetic construct
acctacaacccctccctcaagagtcgagtcaccatctcaatagacacgtccaagaatcagttctccctgaacctggggtctgtgaccgccgcggacagggccgtgtattattgt

SEQ ID NO: 5284 - DNA, 114 bp, Artificial Sequence
  Synthetic construct
aactacaacccgtccctcgagggtcgcgtctccctttcaatagacatgtcaaagaaacagtcgtcactaaaactgacctctgtgaccgccgcggacacggctatttattattgt

SEQ ID NO: 5285 - DNA, 114 bp, Artificial Sequence
  Synthetic construct
aattacaacccctccctcaagagtcgagtcaccatatcagtagacacgtccaagaaccagttctccctgaatatgagctctgtttccgccgcagacacggccgtttattattgt

SEQ ID NO: 5286 - DNA, 114 bp, Artificial Sequence
  Synthetic construct
aagtacaacccctccctcaagggtcgagtcaccatatcatcagacatgtccaagaaccagttctccctcaaactgacctctctgaccgctgcggacacggccatctattactgt

SEQ ID NO: 5287 - DNA, 114 bp, Artificial Sequence
  Synthetic construct
agatacaacccgtccctcaagagtcgggtcaccatatccgttgacacgtccaagaaccacttctccctgaacctgacctctgtgaccgccgcagacacggctgtatattattgt

SEQ ID NO: 5288 - DNA, 114 bp, Artificial Sequence
  Synthetic construct
aactacaacccgtccctcacgagtcgactcaccatatcaattgacacgtccgagaatgaatcttccttgaggctgagctctgtgaccgccgcggacacgggtgtatatttctgt

SEQ ID NO: 5289 - DNA, 114 bp, Artificial Sequence
  Synthetic construct
aactacaacccgtccctcaagagtcgagtcagtatatcagtagacacgtccaagaaccagttttccctgaagttgaactctgtgaccgccgcggacacggctgtgtatttctgt

SEQ ID NO: 5290 - DNA, 114 bp, Artificial Sequence
  Synthetic construct
aattacaacccgtccctcaaaagtcgagtcaccatatcaggagacacgtccaagaaccaattctccctgaagatgaactctgtgaccgccgcggacacggctgtgtattattgt

SEQ ID NO: 5291 - DNA, 114 bp, Artificial Sequence
  Synthetic construct
aactacaacccgtccctcaagagtcgagtcaccatatcagtagacacgtccaagaaccagttctccctgaacctgacctccgtgaccgccgcggacacggctgtttattattgt

SEQ ID NO: 5292 - DNA, 114 bp, Artificial Sequence
  Synthetic construct
gactccaacccgtccctccagagtcgagtttccatttcagttgacacgtccaagaatcaattctccctcactctcacctctctaaccgccgcggacacggccgtgtatttttgt

SEQ ID NO: 5293 - DNA, 114 bp, Artificial Sequence
  Synthetic construct
aattacaacccctccctcaagggtcgagccaccatatcagtagactcgtccaagaaccagttgtccctgaagctgaggtctgtgaccgccgcagacacggccacatatcactgt

SEQ ID NO: 5294 - DNA, 114 bp, Artificial Sequence
  Synthetic construct
agctaccacccctccctcaagagtcgaatcaccatgtccgtagacacgtccaagaaccaggtctccctgaagctgaggtctgttaccgccgctgacacggccgtctattactgt

SEQ ID NO: 5295 - DNA, 114 bp, Artificial Sequence
  Synthetic construct
agtgacaacccgtccctccagagtcgagtcgccatttccgtggacccgtacaagcagcagttctccctgagactgacgtctctgtccgccgcggacacggctgtctactactgt

SEQ ID NO: 5296 - DNA, 114 bp, Artificial Sequence
  Synthetic construct
acctccaatccctccctcaggagtcgagtcaccatttcgattgacacctctaagaatcaattcttcttgaacatggactctctgagtgctgcagacacggccgtctattactgt

SEQ ID NO: 5297 - DNA, 114 bp, Artificial Sequence
  Synthetic construct
aactacatcccctccctcgaaagccgactctccatatcaatggacacgtcgaagaaccagttttccctgaatctgacctctgtgaccgcggcagactcggccgtatacttttgt

SEQ ID NO: 5298 - DNA, 114 bp, Artificial Sequence
  Synthetic construct
tactacaatccgtccctcaagagtcgtatctcattatttgttgacacgtccaagaggcagatctccctgaaggtcaactctgtgaccgccgcagacacggccgtctattactgt

SEQ ID NO: 5299 - DNA, 114 bp, Artificial Sequence
  Synthetic construct
ctatacaacccgtccctcgagagccgagccaccttgtccgtcgacacgtcccagaatcaggtctccctacaattgacttctatgaccgccgcagacgccgctgtctattactgt

SEQ ID NO: 5300 - DNA, 114 bp, Artificial Sequence
  Synthetic construct
ctcatcaaaccgtccctcaagagtcgactttccatgtccaaagacacgtccaatatccaattctccctgagtctgggctctgtgaccgccacagacacggctttttattattgt

SEQ ID NO: 5301 - DNA, 114 bp, Artificial Sequence
  Synthetic construct
tactacaacccgtccctcgagagtcgggtcaccatatccgtagacacgtccaacaaccagttctccttgaggctgatctctgtgaccgccgcagacacggctgaatattactgt

SEQ ID NO: 5302 - DNA, 114 bp, Artificial Sequence
  Synthetic construct
tacttcaacccgtccctcaagaggcgagtcaccatatccgtcgacacgtccaagaaccagttctccctgaagctgagctctgtgaccgccacagacacggctgtgtattactgt

SEQ ID NO: 5303 - DNA, 114 bp, Artificial Sequence
  Synthetic construct
tacttcaacccgtccctcaagagtcgagtcgccatatccgtggacacttccaggaaccagttctccctgaagctgacctctgtgaccgccgcagacacggctgtgtattactgt

SEQ ID NO: 5304 - DNA, 114 bp, Artificial Sequence
  Synthetic construct
tactacaacccgtccctcaagagtcgagtcaccatatccgtagacacgtccaagaaccagttctccctgaaactgagctctgtgaccgccgcagacacggctgtgtattactgt

SEQ ID NO: 5305 - DNA, 114 bp, Artificial Sequence
  Synthetic construct
tactacaacccgtccctcaagagtcgagtcaccatatccgtagacacgtccaagaaccagttctccctgaagctgagctctgtgaccgccgcagacacggctgtgtattactgt

SEQ ID NO: 5306 - DNA, 114 bp, Artificial Sequence
  Synthetic construct
tactacaacccgtccctcaagagtcgagtcaccatatccgtagacacgtccaagaatcagttctccctgaagctgagctctgtgaccgccgcagacacggctgtgtattactgt

SEQ ID NO: 5307 - DNA, 114 bp, Artificial Sequence
  Synthetic construct
tacttcaatccgtccctccagagtcgagccaccttatccgtagacacgtcccagaaccagttctccctgaggctgagctctgtgaccgccgcagacacggctgtgtattactgt

SEQ ID NO: 5308 - DNA, 114 bp, Artificial Sequence
  Synthetic construct
tactacaacccgtccctcaagagtcgagtcaccatatccgtagacacgtccaagaaccagttctccctgaaactgagttctgtgaccgccgcagacacggctgtgtattactgt

SEQ ID NO: 5309 - DNA, 114 bp, Artificial Sequence
  Synthetic construct
aactacaacccctccctccagagtcgaatcaccatatcagtagacacgtccaacaaccagttctccctgaagttgagctctgtgaccgctgcggacacggccgtgtatttctgt

SEQ ID NO: 5310 - DNA, 114 bp, Artificial Sequence
  Synthetic construct
tcctacaacccgtccctcaagagtcgagtgaccatctccttagacatgtcgaagaaccagttctccctgaagctgacctctgtgaccgccgcagacacggccgtgtattattgt

SEQ ID NO: 5311 - DNA, 114 bp, Artificial Sequence
  Synthetic construct
gactacaggtcgtccctcgagagtcgactcaccatatcattagacacgtccaacaaccgcttctccctgagactgaggtctgtgaccgccgcagacacggccatttattactgt

SEQ ID NO: 5312 - DNA, 114 bp, Artificial Sequence
  Synthetic construct
tactacagtccgtccctcaagagtcgagtcaccatatccgtagacacgtccaagaacgaggtctccctgaagctgagctctgtgaccgccgcagacacggccgtatattattgt

SEQ ID NO: 5313 - DNA, 114 bp, Artificial Sequence
  Synthetic construct
tactacaacccgtccctcaagagtcgagtcaccatatcagtagacatgaccaagaaccagttctccctgaagctgagctctgtgaccgccgcagacacggccgtgtattactgt

SEQ ID NO: 5314 - DNA, 114 bp, Artificial Sequence
  Synthetic construct
tactacaattcgtccctcaagagtcgagtcgccatatcggtggacttgtccaagaaccaactctccctgaacctgcgctctgtgacggccgcagacacggccgtgtattattgt

SEQ ID NO: 5315 - DNA, 114 bp, Artificial Sequence
  Synthetic construct
gactacaacccgtccctcaagagtcgagtctccatatcagtagacacgtccaagaaccagttctccctgaagctgacctctgtgaccgccgcagacacggccgtatatttctgt

SEQ ID NO: 5316 - DNA, 114 bp, Artificial Sequence
  Synthetic construct
tactacaacccgtccctcaagagtcgagtcaccatatccgtagacacgtccaagaaccagttgtccctgaacctgaagtctgtgaccgccgcagacacggccgtgtattactgt

SEQ ID NO: 5317 - DNA, 114 bp, Artificial Sequence
  Synthetic construct
tactacagcccgtccctcaagagtcgagtcaccatatcagtagacacgtccaagaaccagttctccctgaagctgaggtctatgaccgccgcagacacggccgtgtattactgt

SEQ ID NO: 5318 - DNA, 114 bp, Artificial Sequence
  Synthetic construct
tactacaacccgtccctcaagagtcgagtcaccatatcagtagacacgtccaagaaccagttctccctgaagctgagctctgtgaccgccgcagacacggccgtgtattactgt

SEQ ID NO: 5319 - DNA, 114 bp, Artificial Sequence
  Synthetic construct
tactacaacccgtccctcaagagtcgagtcatcatatcagtagacacgtccaagaaccagttctccctgaggctgagctctgtgaccgccgcagactcggccgtgtattactgt

SEQ ID NO: 5320 - DNA, 114 bp, Artificial Sequence
  Synthetic construct
tactacaacccgtccctcaagagtcgagtcaccatatcagttgacacgtccaagaaccagttcttcctgaacctgacttctgcgaccgccgcagacacggccgtgtatttctgt

SEQ ID NO: 5321 - DNA, 114 bp, Artificial Sequence
  Synthetic construct
tactacaacccgtccctcaagagtcgagtcaccatatccgtagacacgtccaagaatcagttttccctgaaactgagctctgtgaccgccgcagacacggccgtgtattactgt

SEQ ID NO: 5322 - DNA, 114 bp, Artificial Sequence
  Synthetic construct
tactataacccgtccctcaagagtcgagtcaccttatcaatggacacctccaagaaccagttctctttgaggttgacctctgtgaccgccgcagacacggccatgtattattgt

SEQ ID NO: 5323 - DNA, 114 bp, Artificial Sequence
  Synthetic construct
cactttaacccgtccctccagagtcgagtgtccatgtcagtagacacgtccaagaacgaattctttctgaacctgaggtctgtcaccgccgccgacacggccgtttattattgt

SEQ ID NO: 5324 - DNA, 114 bp, Artificial Sequence
  Synthetic construct
tactacaacccgtccctgaagagtcgagtcaccatttccctggacacgtccaagaaccagatctccctgaacctgaggtctgtgaccgccgcagacacggccatttattactgt

SEQ ID NO: 5325 - DNA, 114 bp, Artificial Sequence
  Synthetic construct
tattacaacccgtccctcaagagtcgagtctccatatccgtagacacgtccacgaatcacttctccctgaagctgacctctgtgaccgccgcagacacggctgtgtatttctgt

SEQ ID NO: 5326 - DNA, 114 bp, Artificial Sequence
  Synthetic construct
taccagaacccgtccctcaagaggcgagtcaccatatccatggacacgtccagccaccaattctccctggacctgcgctctgtgaccgccgcagattcggccgtttattactgt

SEQ ID NO: 5327 - DNA, 114 bp, Artificial Sequence
  Synthetic construct
tactacaacccgtccctcaagagtcgagtcaccatttcagtggacacgtccaagaaccagttctccctgaagctgagctctgtgaccgccgcagacacggccgtttattattgt

SEQ ID NO: 5328 - DNA, 114 bp, Artificial Sequence
  Synthetic construct
tactacaatccggccttcaagagtcgcgcctccatatctgtggacacgtccaagaacctgttctccctgaatgtgaagtctgcgaccgccgcagacacggccgtgtactattgt

SEQ ID NO: 5329 - DNA, 114 bp, Artificial Sequence
  Synthetic construct
aactacgcacagaagttccagggcagagtcacgattatcgcggacgtgtccacgagcacagcctacctggaactgagcagcctgagatctgaggacacggccgtttattactgc

SEQ ID NO: 5330 - DNA, 114 bp, Artificial Sequence
  Synthetic construct
aattacgcacagaaattcaagggcagagtcatcattaccgcggacgaatccacaaacacagcctacatggagctgaatagtctgacatcagatgacacggccgtctactactgt

SEQ ID NO: 5331 - DNA, 114 bp, Artificial Sequence
  Synthetic construct
aactacgcacagaagttccagggcagagtcaccataagcgcggacgaacgcacgaatacaatctatatggaggtgagcagcctgacatctgaggacacggccgtctatttttgt

SEQ ID NO: 5332 - DNA, 114 bp, Artificial Sequence
  Synthetic construct
aactacgcacagaaattccagggcagagtcacgatcaccagagacgattctaagaccacaatttatatggagttgagcagtctgagatctgaggacacggccgtctattactgt

SEQ ID NO: 5333 - DNA, 114 bp, Artificial Sequence
  Synthetic construct
aactacgcacagggactcgaggacagagtcaccatgaccacagacacaaccacaaagacagcctatctggagttgaggagcctgaaatctgacgacacggccgtctatttctgt

SEQ ID NO: 5334 - DNA, 114 bp, Artificial Sequence
  Synthetic construct
tactacgcagactccgtgaagggccgattcaccatctccagagacgattccaagaacacgctgtatctgcaattgaccagcctgagacctgaagacacggctgtatattactgt

SEQ ID NO: 5335 - DNA, 114 bp, Artificial Sequence
  Synthetic construct
cattacgcagactcagtgaggggccgattctccgtctccagagacaacgccaagaattcagtgtttctgcaaatggacagcctgagagtcgaggacacggctgtttattattgt

SEQ ID NO: 5336 - DNA, 114 bp, Artificial Sequence
  Synthetic construct
ctatatgcagagaagttccagggcagagtcaccatcaccgcagacacgtctacagacacactcttcatggaactgagcaatttgaaatctgacgacacggccgtgtattactgt

SEQ ID NO: 5337 - DNA, 114 bp, Artificial Sequence; identical to SEQ ID NO: 1792
  Synthetic construct

SEQ ID NO: 5338 - DNA, 114 bp, Artificial Sequence
  Synthetic construct
gactatatagactctgtgaagggccgattcaccatttccagggacaaatccaggaactcgctctatctgcaaatggacagcctcaaagtcgaagactcgggtgtctattattgt

SEQ ID NO: 5339 - DNA, 114 bp, Artificial Sequence
  Synthetic construct
cattatgcagactctgtgaagggccgattcaccatctccagagacaacgccaagaactccctctatctggagatgaacagtctgagagtcgaagacacggccttgtattactgc

SEQ ID NO: 5340 - DNA, 114 bp, Artificial Sequence
  Synthetic construct
caatacgcagacgctgtgaggggtcggttcaccatctccagggacaacgccgagaactcactgtatctacaaatgaacagcctgagagccgacgacacggctgtttattattgt

SEQ ID NO: 5341 - DNA, 114 bp, Artificial Sequence
  Synthetic construct
ttctacgcagactccgtgaagggccgattcaccatctccagagacaattccaagaacacactatctctgcaaatggacagcctgagagctgacgacacggccacttatttctgt

SEQ ID NO: 5342 - DNA, 114 bp, Artificial Sequence
  Synthetic construct
tactatgcacagaaatttcagggcagggtcaccatgaccagggacacgtccatcagtgctgcctacatggagttgagcaggctgaaatatgacgacgcggccatttatttctgt

SEQ ID NO: 5343 - DNA, 114 bp, Artificial Sequence
  Synthetic construct
atctacgcacagaagttcctgggcagagtcaccatgaccgaggacacaactgcagacacagcctacatggagctgaccagcctgacatttgcggacacggccgtgtattactgt

SEQ ID NO: 5344 - DNA, 114 bp, Artificial Sequence
  Synthetic construct
ttctacagcccgtctctaaaggacagactctccatctccaaggatactttcattaaccaggtggtccttacaatgaccaatgtggaccctctggacacagccacatattactgt

SEQ ID NO: 5345 - DNA, 114 bp, Artificial Sequence
  Synthetic construct
acctacgcacagaagttcggggggagagtcaccattgacgcggacgaattcacgagcacagccttcatggaactgagcgacctgcgatctgaagacactgccctgtactcctgt

SEQ ID NO: 5346 - DNA, 114 bp, Artificial Sequence
  Synthetic construct
tactatgcagactccgtgaagggccgattcaccatctccagagacaattccaagaacacggtgtatttgcaaatgaacagcctgggagctgacgacacggctgtatatttctgt

SEQ ID NO: 5347 - DNA, 34 bp, Artificial Sequence; identical to SEQ ID NO: 1794
  Synthetic construct

SEQ ID NO: 5348 - DNA, 34 bp, Artificial Sequence
  Synthetic construct
tggggccaagggacactggtcaccgtctcttcag

SEQ ID NO: 5349 - DNA, 33 bp, Artificial Sequence
  Synthetic construct
tggggccaagggaccacggtcaccgtctcctca

SEQ ID NO: 5350 - DNA, 33 bp, Artificial Sequence
  Synthetic construct
tggggcacagggaccacggtcaccgtctccaca

SEQ ID NO: 5351 - DNA, 34 bp, Artificial Sequence
  Synthetic construct
tggggcccgggaacccaggtcaccgtctcctcag

SEQ ID NO: 5352 - DNA, 34 bp, Artificial Sequence
  Synthetic construct
tggggccagggaacccgggtcaccgtctcctcag

SEQ ID NO: 5353 - DNA, 34 bp, Artificial Sequence; identical to SEQ ID NO: 1793
  Synthetic construct

SEQ ID NO: 5354 - DNA, 34 bp, Artificial Sequence
  Synthetic construct
tggggccagggaaccaaggtcaccgtctcctcag

SEQ ID NO: 5355 - DNA, 34 bp, Artificial Sequence
  Synthetic construct
tggggccagggaagcctggtcaccgtctcctcag

SEQ ID NO: 5356 - DNA, 34 bp, Artificial Sequence
  Synthetic construct
tggggccaagggacagtggtcaccgtctcttcag

SEQ ID NO: 5357 - DNA, 34 bp, Artificial Sequence
  Synthetic construct
tggggccagggaaccttggtcaccgtctcctcag

SEQ ID NO: 5358 - DNA, 34 bp, Artificial Sequence
  Synthetic construct
tgggggcagggaaccctggtcaccgtctcctcag

SEQ ID NO: 5359 - DNA, 34 bp, Artificial Sequence
  Synthetic construct
tggggccagggaacccaggtcaccgtctcctcag

SEQ ID NO: 5360 - DNA, 34 bp, Artificial Sequence
  Synthetic construct
tggggccagggatccctggtcaccgtctcctcag

SEQ ID NO: 5361 - DNA, 34 bp, Artificial Sequence
  Synthetic construct
tggggccagggaactctggtcaccgtctcctcag

SEQ ID NO: 5362 - DNA, 34 bp, Artificial Sequence
  Synthetic construct
tggggccaagggacaatggtcaccgtctcttcag

SEQ ID NO: 5363 - DNA, 33 bp, Artificial Sequence
  Synthetic construct
tggggcaaagggaccacggtcactgtctcctca

SEQ ID NO: 5364 - DNA, 34 bp, Artificial Sequence
  Synthetic construct
tggggccaggggacaacactcaccgtctcttcag

SEQ ID NO: 5365 - DNA, 34 bp, Artificial Sequence
  Synthetic construct
tggggccagggaaccctggtcacagtctcctcag

SEQ ID NO: 5366 - DNA, 34 bp, Artificial Sequence
  Synthetic construct
tggggccaggggacactggtcaccgtctcttcag

SEQ ID NO: 5367 - DNA, 33 bp, Artificial Sequence
  Synthetic construct
tggggcaaagggaccacggtcaccgtctcctca

SEQ ID NO: 5368 - DNA, 34 bp, Artificial Sequence
  Synthetic construct
tggggccagggcaccctggtcaccgtctcctcag

SEQ ID NO: 5369 - DNA, 33 bp, Artificial Sequence
  Synthetic construct
tggggcaatgggaccacggtcaccgtctcctca

SEQ ID NO: 5370 - DNA, 34 bp, Artificial Sequence; identical to SEQ ID NO: 1796
  Synthetic construct

SEQ ID NO: 5371 - DNA, 34 bp, Artificial Sequence
  Synthetic construct
tggggccgagggacaatggtcaccgtctcttcag

SEQ ID NO: 5372 - DNA, 34 bp, Artificial Sequence
  Synthetic construct
tggggccaagggacgatggtcaccgtctcctcag

SEQ ID NO: 5373 - DNA, 34 bp, Artificial Sequence
  Synthetic construct
tggggccaggggactctggtgaccgtctcctcag

SEQ ID NO: 5374 - DNA, 34 bp, Artificial Sequence
  Synthetic construct
tggggccagggaaccctggtcatcgtctcctcag

SEQ ID NO: 5375 - DNA, 33 bp, Artificial Sequence
  Synthetic construct
tggggcaaagggaccacagtcaccgtctcctca

SEQ ID NO: 5376 - DNA, 34 bp, Artificial Sequence
  Synthetic construct
tggggccagggaaccctggtcagtgtctcctcag

SEQ ID NO: 5377 - DNA, 34 bp, Artificial Sequence
  Synthetic construct
tggggcaaagggaccacggtcaccgtctcctcag

SEQ ID NO: 5378 - DNA, 34 bp, Artificial Sequence
  Synthetic construct
tggggccagggaaccccggtcaccgtctcctcag

SEQ ID NO: 5379 - DNA, 34 bp, Artificial Sequence
  Synthetic construct
tggggccaagggacagtagtcaccgtctcttcag

SEQ ID NO: 5380 - DNA, 34 bp, Artificial Sequence
  Synthetic construct
tggggacagggaaccctggtcgccgtctcctcag

SEQ ID NO: 5381 - DNA, 33 bp, Artificial Sequence
  Synthetic construct
tggggcagcgggaccacggtaatcgtctcctcg

SEQ ID NO: 5382 - DNA, 34 bp, Artificial Sequence
  Synthetic construct
tggggccaagggacattgctcaccgtctcttcag

SEQ ID NO: 5383 - DNA, 33 bp, Artificial Sequence
  Synthetic construct
tggggcaagggggcctcggtcaccgtctcctca

SEQ ID NO: 5384 - DNA, 34 bp, Artificial Sequence
  Synthetic construct
tggggccgtgggaccctggtcactgtctcctcag

SEQ ID NO: 5385 - DNA, 34 bp, Artificial Sequence
  Synthetic construct
tggggccttggcacccaggtcactgtcgcctcag

SEQ ID NO: 5386 - DNA, 34 bp, Artificial Sequence
  Synthetic construct
tggggccagggaatatcggtcaccgtctcctccg

SEQ ID NO: 5387 - DNA, 33 bp, Artificial Sequence
  Synthetic construct
tggggcaaagggaccacggtctccgtctcctca

SEQ ID NO: 5388 - DNA, 34 bp, Artificial Sequence
  Synthetic construct
tggggcctggggacaacggtcatcgtctcttcag

SEQ ID NO: 5389 - DNA, 34 bp, Artificial Sequence
  Synthetic construct
tggggccagggaaccctggtctccgtctccacag

SEQ ID NO: 5390 - DNA, 34 bp, Artificial Sequence
  Synthetic construct
tggggccagggaaccctggtcaccgtctcgtcag

SEQ ID NO: 5391 - DNA, 34 bp, Artificial Sequence
  Synthetic construct
tggggccagggaaccctggtcaccgtctcctcat

SEQ ID NO: 5392 - DNA, 34 bp, Artificial Sequence
  Synthetic construct
tggggccagggtaccctggtcaccgtctcctcag

SEQ ID NO: 5393 - DNA, 34 bp, Artificial Sequence
  Synthetic construct
tggggccagggcaccctggtcaccgtctcgtcag

SEQ ID NO: 5394 - DNA, 34 bp, Artificial Sequence
  Synthetic construct
tggggccaggggacccaggtcaccgtctcctctg

SEQ ID NO: 5395 - DNA, 34 bp, Artificial Sequence
  Synthetic construct
tggggccaagggactatggtcaccgtctcttcag

SEQ ID NO: 5396 - DNA, 34 bp, Artificial Sequence
  Synthetic construct
tggggccagggaaccctggtctccgtctcctcag

SEQ ID NO: 5397 - DNA, 34 bp, Artificial Sequence
  Synthetic construct
tggggccagggaaccctggtcaccgtctcctcaa

SEQ ID NO: 5398 - DNA, 34 bp, Artificial Sequence
  Synthetic construct
tggggccacgggacagtggtcaccgtctcctcag

SEQ ID NO: 5399 - DNA, 34 bp, Artificial Sequence
  Synthetic construct
tggggccaagggacactggtcaccgtctcttcga

SEQ ID NO: 5400 - DNA, 34 bp, Artificial Sequence
  Synthetic construct
tggggccagggaacccaggtcatcgtctcctcag

SEQ ID NO: 5401 - DNA, 34 bp, Artificial Sequence
  Synthetic construct
tggggccagggaaccctggtcactgtctcttccg

SEQ ID NO: 5402 - DNA, 34 bp, Artificial Sequence
  Synthetic construct
tggggccaagggacaagggtcaccgtctcttcag

SEQ ID NO: 5403 - DNA, 33 bp, Artificial Sequence
  Synthetic construct
tggggcaaagggacaacggtcaccgtctcctca

SEQ ID NO: 5404 - DNA, 34 bp, Artificial Sequence
  Synthetic construct
tggggccagggaaccctggtcaccgtctccccag

SEQ ID NO: 5405 - DNA, 34 bp, Artificial Sequence
  Synthetic construct
tggggccgtggcaccctgatcactgtctcctcag

SEQ ID NO: 5406 - DNA, 34 bp, Artificial Sequence
  Synthetic construct
tggggccaagggacgatggtcaccgtctcttcag

SEQ ID NO: 5407 - DNA, 34 bp, Artificial Sequence
  Synthetic construct
tggggccagggaaccctggtcaccgtctcctcac

SEQ ID NO: 5408 - DNA, 34 bp, Artificial Sequence
  Synthetic construct
tggggccaagggacaagggtcatcgtctcttcag

SEQ ID NO: 5409 - DNA, 34 bp, Artificial Sequence
  Synthetic construct
tggggccagggacttctggtcaccgtctcctcag

SEQ ID NO: 5410 - DNA, 34 bp, Artificial Sequence
  Synthetic construct
tggggccaagggacaaaggtcaccgtctcttcag

SEQ ID NO: 5411 - DNA, 34 bp, Artificial Sequence
  Synthetic construct
tggggccaagggacaatggtcaacgtctcttcag

SEQ ID NO: 5412 - DNA, 33 bp, Artificial Sequence
  Synthetic construct
tggggcggagggaccacggtcaccgtctcttca

SEQ ID NO: 5413 - DNA, 34 bp, Artificial Sequence
  Synthetic construct
tggggcctgggaaccctggtcaccgtctcctcag

SEQ ID NO: 5414 - DNA, 33 bp, Artificial Sequence
  Synthetic construct
tggggcagagggaccacggtcaccgtctcccca

SEQ ID NO: 5415 - DNA, 34 bp, Artificial Sequence
  Synthetic construct
tggggccggggaaccgtggtcaccgtctcctcag

SEQ ID NO: 5416 - DNA, 34 bp, Artificial Sequence
  Synthetic construct
tggggccagggaaccctcgtcaccgtctcctcag

SEQ ID NO: 5417 - DNA, 34 bp, Artificial Sequence
  Synthetic construct
tggggccagggcaccctggtcgtcgtctcctcag

SEQ ID NO: 5418 - DNA, 33 bp, Artificial Sequence
  Synthetic construct
tggggcaaagggatcacggtcaccgtctcctca

SEQ ID NO: 5419 - DNA, 34 bp, Artificial Sequence
  Synthetic construct
tggggccaaggaacaatggtcaccgtctcttcag

SEQ ID NO: 5420 - DNA, 33 bp, Artificial Sequence
  Synthetic construct
tggggcaaagggaccacggtcaccgtctcttca

SEQ ID NO: 5421 - DNA, 34 bp, Artificial Sequence
  Synthetic construct
tggggccagggaacccgcgtcaccgtctcctcag

SEQ ID NO: 5422 - DNA, 34 bp, Artificial Sequence
  Synthetic construct
tggggccaagggacaatggtcaccgtctccttag

SEQ ID NO: 5423 - DNA, 34 bp, Artificial Sequence
  Synthetic construct
tggggccaggggacaaaggtcaccgtctcttcag

SEQ ID NO: 5424 - DNA, 33 bp, Artificial Sequence
  Synthetic construct
tggggcaaagggactacggtcaccgtctcctca

SEQ ID NO: 5425 - DNA, 33 bp, Artificial Sequence
  Synthetic construct
tggggcaaagggaccacggtcaccgtctcctct

SEQ ID NO: 5426 - DNA, 34 bp, Artificial Sequence
  Synthetic construct
tggggccaaggaaccctggtcaccgtctcctcag

SEQ ID NO: 5427 - DNA, 33 bp, Artificial Sequence
  Synthetic construct
tggggcaacgggaccacgatcactgtctcctca

SEQ ID NO: 5428 - DNA, 34 bp, Artificial Sequence
  Synthetic construct
tggggccaagggacactggtcaccgtcgcctcag

SEQ ID NO: 5429 - DNA, 34 bp, Artificial Sequence
  Synthetic construct
tggggccagggaaccctggtcactgtctcgtcag

SEQ ID NO: 5430 - DNA, 34 bp, Artificial Sequence
  Synthetic construct
tggggccaggggaccctggtcaccgtcccctcag

SEQ ID NO: 5431 - DNA, 34 bp, Artificial Sequence
  Synthetic construct
tggggccagggaacctgggtcaccgtctcctcag

SEQ ID NO: 5432 - DNA, 34 bp, Artificial Sequence
  Synthetic construct
tggggccaagggacaatggtcatcgtctcttcag

SEQ ID NO: 5433 - DNA, 34 bp, Artificial Sequence
  Synthetic construct
tggggccagggagtcctggtcaccgtctcctcag

SEQ ID NO: 5434 - DNA, 33 bp, Artificial Sequence
  Synthetic construct
tggggtaaagggaccacggtcaccgtctcctca

SEQ ID NO: 5435 - DNA, 33 bp, Artificial Sequence
  Synthetic construct
tggggcaaagggaccgcggtcaccgtctcctca

SEQ ID NO: 5436 - DNA, 34 bp, Artificial Sequence
  Synthetic construct
tggggccagggaacccaggtcaccgtctccgcag

SEQ ID NO: 5437 - DNA, 34 bp, Artificial Sequence
  Synthetic construct
tggggcacaggcattatggtcacagtctcctcag

SEQ ID NO: 5438 - DNA, 33 bp, Artificial Sequence
  Synthetic construct
tggggtaaagggaccacagtcaccgtctcctca

SEQ ID NO: 5439 - DNA, 33 bp, Artificial Sequence
  Synthetic construct
tggggcaaggggaccacggtcttcgtctcctca

SEQ ID NO: 5440 - DNA, 34 bp, Artificial Sequence
  Synthetic construct
tggggccaagggacattggtcaccgtctcttcag

SEQ ID NO: 5441 - DNA, 34 bp, Artificial Sequence
  Synthetic construct
tggggccagggaacccgggtcaccgtctcctctg

SEQ ID NO: 5442 - DNA, 34 bp, Artificial Sequence
  Synthetic construct
tggggcccgggatccctggtcaccgtctcctcag

SEQ ID NO: 5443 - DNA, 25 bp, Artificial Sequence
  Synthetic construct
tggggccagggaaccttggtcaccg

SEQ ID NO: 5444 - DNA, 34 bp, Artificial Sequence
  Synthetic construct
tggggccagggagccctggtcaccgtctcctcag

SEQ ID NO: 5445 - DNA, 34 bp, Artificial Sequence
  Synthetic construct
tggggccagggaactttggtcaccgtctcctcag

SEQ ID NO: 5446 - DNA, 34 bp, Artificial Sequence
  Synthetic construct
tggggccgtggcaccctggtcactgtctcctcag

SEQ ID NO: 5447 - DNA, 34 bp, Artificial Sequence
  Synthetic construct
gtgggccagggaaccctggtcaccgtctcctcag

SEQ ID NO: 5448 - DNA, 34 bp, Artificial Sequence
  Synthetic construct
tggggccaagggacaatggtcaccgtctcctcag

SEQ ID NO: 5449 - DNA, 34 bp, Artificial Sequence
  Synthetic construct
tggggccagggaatcctggtcaccgtcgcctcag

SEQ ID NO: 5450 - DNA, 34 bp, Artificial Sequence
  Synthetic construct
tggggccagggcaccctggtcaccgtctcctctg

SEQ ID NO: 5451 - DNA, 34 bp, Artificial Sequence; identical to SEQ ID NO: 1795
  Synthetic construct

SEQ ID NO: 5452 - DNA, 34 bp, Artificial Sequence
  Synthetic construct
tgggggcagggagtcctggtcaccgtctcctcag

SEQ ID NO: 5453 - DNA, 34 bp, Artificial Sequence
  Synthetic construct
tggggccaggggacaatggtcatcgtctcttcag

SEQ ID NO: 5454 - DNA, 34 bp, Artificial Sequence
  Synthetic construct
tggggccagggagccctggtcaccgtctcctcac

SEQ ID NO: 5455 - DNA, 33 bp, Artificial Sequence
  Synthetic construct
tggggccgagggaccaccgtcaccgtctcctca

SEQ ID NO: 5456 - DNA, 34 bp, Artificial Sequence
  Synthetic construct
tggggccagggcaccctggtcatcgtctcctcag

SEQ ID NO: 5457 - DNA, 34 bp, Artificial Sequence
  Synthetic construct
tggggcccgggaaccctggtcaccgtctcctcag

SEQ ID NO: 5458 - DNA, 34 bp, Artificial Sequence
  Synthetic construct
tggggccaagggacaacggtcaccgtctcttcag

SEQ ID NO: 5459 - DNA, 34 bp, Artificial Sequence
  Synthetic construct
tggggccagggaaccctggccaccgtctcctcag

SEQ ID NO: 5460 - DNA, 34 bp, Artificial Sequence
  Synthetic construct
tggggccagggagcccaggtcaccgtctcctcag

SEQ ID NO: 5461 - DNA, 34 bp, Artificial Sequence
  Synthetic construct
tggggccagggagcccaagtcaccgtctcctcag

SEQ ID NO: 5462 - DNA, 34 bp, Artificial Sequence
  Synthetic construct
tggggacagggaacccgcgtcaccgtctcctcag

SEQ ID NO: 5463 - DNA, 34 bp, Artificial Sequence
  Synthetic construct
tggggccagggagccctggtcaccgtcgcctcag

SEQ ID NO: 5464 - DNA, 34 bp, Artificial Sequence
  Synthetic construct
tggggccagggaaccctggtcaccgtctccacgg

SEQ ID NO: 5465 - DNA, 34 bp, Artificial Sequence
  Synthetic construct
tggggacagggaaccctggtcgccgtctcctccg

SEQ ID NO: 5466 - DNA, 34 bp, Artificial Sequence
  Synthetic construct
tggggccagggaacccaggtcaccgtctcctcgg

SEQ ID NO: 5467 - DNA, 34 bp, Artificial Sequence
  Synthetic construct
tggggccgggggacagtggtcaccgtctcctcag

SEQ ID NO: 5468 - DNA, 34 bp, Artificial Sequence
  Synthetic construct
tggggccagggaaccctggtcaccgtctcctctg

SEQ ID NO: 5469 - DNA, 33 bp, Artificial Sequence
  Synthetic construct
tggggcaaggggaccgcggtcacggtctcctca

SEQ ID NO: 5470 - DNA, 34 bp, Artificial Sequence
  Synthetic construct
tggggccaaggggcactggtcaccgtctcctcag

SEQ ID NO: 5471 - DNA, 34 bp, Artificial Sequence
  Synthetic construct
tggggccagggaaccctggtcaccgtcacctcag

SEQ ID NO: 5472 - DNA, 34 bp, Artificial Sequence
  Synthetic construct
tggggccagggaaccgtggtcaccgtctcttcag

SEQ ID NO: 5473 - DNA, 34 bp, Artificial Sequence
  Synthetic construct
tggggccagggaaccctggtccccgtctcctcag

SEQ ID NO: 5474 - DNA, 34 bp, Artificial Sequence
  Synthetic construct
tggggccagggaaccgtggtcaccgtctcctcag

SEQ ID NO: 5475 - DNA, 34 bp, Artificial Sequence
  Synthetic construct
tggggccgagggacagtggtcaccgtctccccag

SEQ ID NO: 5476 - DNA, 34 bp, Artificial Sequence
  Synthetic construct
tggggccagggcaccctggtcaccgtcacctccg

SEQ ID NO: 5477 - DNA, 33 bp, Artificial Sequence
  Synthetic construct
tggggcaaggggaccacggtcaccgtctcctca

SEQ ID NO: 5478 - DNA, 33 bp, Artificial Sequence
  Synthetic construct
tggggcgaagggaccgcggtcaccgtctcctca

SEQ ID NO: 5479 - DNA, 33 bp, Artificial Sequence
  Synthetic construct
tggggcaaagggacgacggtcaccgtctcctca

SEQ ID NO: 5480 - DNA, 34 bp, Artificial Sequence
  Synthetic construct
tggggccacggaaccctggtcaccgtctccgcag

SEQ ID NO: 5481 - DNA, 34 bp, Artificial Sequence
  Synthetic construct
tggggccaagggacaatggtcaccgtctcttcac

SEQ ID NO: 5482 - DNA, 34 bp, Artificial Sequence
  Synthetic construct
tggggccaagggacaccggtcaccgtctcttcag

SEQ ID NO: 5483 - DNA, 34 bp, Artificial Sequence
  Synthetic construct
tggggccagggcaccgtggtcaccgtctcctcag

SEQ ID NO: 5484 - DNA, 34 bp, Artificial Sequence
  Synthetic construct
tggggccagggaaccctagtctccgtctccccag

SEQ ID NO: 5485 - DNA, 34 bp, Artificial Sequence
  Synthetic construct
tggggccagggaaccctggtcaccgtctcctcgg

SEQ ID NO: 5486 - DNA, 34 bp, Artificial Sequence
  Synthetic construct
tggggccagggaaccctggtcaccgtctcatcag

SEQ ID NO: 5487 - DNA, 34 bp, Artificial Sequence
  Synthetic construct
tggggccaggggacaaagctcatcgtctcttcag

SEQ ID NO: 5488 - DNA, 34 bp, Artificial Sequence
  Synthetic construct
tggggccgtggcaccctgctcactgtctcctcag

SEQ ID NO: 5489 - DNA, 34 bp, Artificial Sequence
  Synthetic construct
tggggccgtggcactttggtcactgtctccccag

SEQ ID NO: 5490 - DNA, 34 bp, Artificial Sequence
  Synthetic construct
tggggccaaggaaccctggtcaccgtctcctcat

SEQ ID NO: 5491 - DNA, 34 bp, Artificial Sequence
  Synthetic construct
tggggccagggaaccctggtcagcgtctcctcag

SEQ ID NO: 5492 - DNA, 34 bp, Artificial Sequence
  Synthetic construct
tggggccagggaaccctggtcaccgtctcctccg

SEQ ID NO: 5493 - DNA, 34 bp, Artificial Sequence
  Synthetic construct
tggggccagggaaccccggtcagcgtctcatcag

SEQ ID NO: 5494 - DNA, 34 bp, Artificial Sequence
  Synthetic construct
tggggccagggcgccctgctcaccgtgtccgcag

SEQ ID NO: 5495 - DNA, 34 bp, Artificial Sequence
  Synthetic construct
tggggccagggaaccctggttgccgtctctgcag

SEQ ID NO: 5496 - DNA, 34 bp, Artificial Sequence
  Synthetic construct
tggggccgggggaccacagtcaccgtctcttcag

SEQ ID NO: 5497 - DNA, 34 bp, Artificial Sequence
  Synthetic construct
tggggccatggaaccctggtcaccgtctcctcag

SEQ ID NO: 5498 - DNA, 34 bp, Artificial Sequence
  Synthetic construct
tggggccagggaaccccggtcatcgtctcctcag

SEQ ID NO: 5499 - DNA, 34 bp, Artificial Sequence
  Synthetic construct
tggggccaagggacactggtcaccgtctcctcag

SEQ ID NO: 5500 - DNA, 34 bp, Artificial Sequence
  Synthetic construct
tggggacagggagccctagtcaccgtctcctcag

SEQ ID NO: 5501 - DNA, 34 bp, Artificial Sequence
  Synthetic construct
tggggccagggaaccctggtgaccgtctcctcag

SEQ ID NO: 5502 - DNA, 34 bp, Artificial Sequence
  Synthetic construct
tggggccaggggacaatggtcaccgtctcctcag

SEQ ID NO: 5503 - DNA, 34 bp, Artificial Sequence
  Synthetic construct
tggggccagggaaccctggtcaccgtctccgccg

SEQ ID NO: 5504 - DNA, 34 bp, Artificial Sequence
  Synthetic construct
tggggccaagggacattggtcaccgtctcctcag

SEQ ID NO: 5505 - DNA, 34 bp, Artificial Sequence
  Synthetic construct
tggggccaagggacaatggtcaccgtgttttcag

SEQ ID NO: 5506 - DNA, 33 bp, Artificial Sequence
  Synthetic construct
tgggggaaagggaccacggtcatcgtctcctca

SEQ ID NO: 5507 - DNA, 34 bp, Artificial Sequence
  Synthetic construct
tggggcccgggaaccctggtcatcgtctcgtcag

SEQ ID NO: 5508 - DNA, 34 bp, Artificial Sequence
  Synthetic construct
tggggccgggggacaatggtcatcgtctcttcag

SEQ ID NO: 5509 - DNA, 34 bp, Artificial Sequence
  Synthetic construct
tggggccagggaacccgggtcaccgtctcttcag

SEQ ID NO: 5510 - DNA, 34 bp, Artificial Sequence
  Synthetic construct
tggggccaagggacaattgtcaccgtctcctcag

SEQ ID NO: 5511 - DNA, 34 bp, Artificial Sequence
  Synthetic construct
tggggccagggagtcctggtcaccgtctcctctg

SEQ ID NO: 5512 - DNA, 34 bp, Artificial Sequence
  Synthetic construct
tggggccagggaacccaggtcaccgtcgcctcag

SEQ ID NO: 5513 - DNA, 33 bp, Artificial Sequence
  Synthetic construct
tggggcaaagggaccacggtcaccgtctcatca

SEQ ID NO: 5514 - DNA, 30 bp, Artificial Sequence
  Synthetic construct
tggggccagggaaccctggtcaccgtctcc

SEQ ID NO: 5515 - DNA, 34 bp, Artificial Sequence
  Synthetic construct
tggggccaggggatcctggtcaccgtctcctcag

SEQ ID NO: 5516 - DNA, 33 bp, Artificial Sequence
  Synthetic construct
tggggcacagggaccacggtcaccgtctcctcc

SEQ ID NO: 5517 - DNA, 34 bp, Artificial Sequence
  Synthetic construct
tggggccagggaactctggtcaccgtctcctcct

SEQ ID NO: 5518 - DNA, 34 bp, Artificial Sequence
  Synthetic construct
tggggccagggaaccctggtcaacgtctcctcag

SEQ ID NO: 5519 - DNA, 34 bp, Artificial Sequence
  Synthetic construct
tggggccaggggacccgggtcaccgtctcctcag

SEQ ID NO: 5520 - DNA, 33 bp, Artificial Sequence
  Synthetic construct
tggggcaatggggccacggtcaccgtctcctca

SEQ ID NO: 5521 - DNA, 34 bp, Artificial Sequence
  Synthetic construct
tggggccagggggccctggtgaccgtctcctcag

SEQ ID NO: 5522 - DNA, 34 bp, Artificial Sequence
  Synthetic construct
tggggccaagggacaatggtcgccgtctcttcgg

SEQ ID NO: 5523 - DNA, 34 bp, Artificial Sequence
  Synthetic construct
tggggccagggcaccgtagtcaccgtctcttcaa

SEQ ID NO: 5524 - DNA, 34 bp, Artificial Sequence
  Synthetic construct
tggggccagggaatcctggtcaccgtctcctcag

SEQ ID NO: 5525 - DNA, 34 bp, Artificial Sequence
  Synthetic construct
tggggccacgggacaaaggtcactgtctctgcag

SEQ ID NO: 5526 - DNA, 34 bp, Artificial Sequence
  Synthetic construct
tggggccagggagccctggtcacggtctcctcag

SEQ ID NO: 5527 - DNA, 34 bp, Artificial Sequence
  Synthetic construct
tggggccggggaacccaggtcaccgtctcctcag

SEQ ID NO: 5528 - DNA, 33 bp, Artificial Sequence
  Synthetic construct
tggggcaaaggggccacggtcaccgtctcctca

SEQ ID NO: 5529 - DNA, 34 bp, Artificial Sequence
  Synthetic construct
tggggccagggaaccctggtcactgtctcctctg

SEQ ID NO: 5530 - DNA, 34 bp, Artificial Sequence
  Synthetic construct
tggagcccgggaaccctggtcaccgtctcctcag

SEQ ID NO: 5531 - DNA, 33 bp, Artificial Sequence
  Synthetic construct
tggggcgaagggaccgcggtcaaggtctcctca

SEQ ID NO: 5532 - DNA, 34 bp, Artificial Sequence
  Synthetic construct
tggagccagggaaccctggtcaccgtctcctcag

SEQ ID NO: 5533 - DNA, 34 bp, Artificial Sequence
  Synthetic construct
tggggccagggagccctggtcaccgtctcctccg

SEQ ID NO: 5534 - DNA, 34 bp, Artificial Sequence
  Synthetic construct
tggggcccgggactcttggtcaccgtctccgcag

SEQ ID NO: 5535 - DNA, 34 bp, Artificial Sequence
  Synthetic construct
tggggccagggaaccctggttagcgtctcctcag

SEQ ID NO: 5536 - DNA, 34 bp, Artificial Sequence
  Synthetic construct
tggagcccgggatcgtgggtcaccatctcctcag

SEQ ID NO: 5537 - DNA, 34 bp, Artificial Sequence
  Synthetic construct
tggggccagggaaccctggtcaccgtctactcag

SEQ ID NO: 5538 - DNA, 34 bp, Artificial Sequence
  Synthetic construct
tggggccagggaaccctcgtcagcgtctcctcag

SEQ ID NO: 5539 - DNA, 33 bp, Artificial Sequence
  Synthetic construct
tggggcacagggaccacggtcaccgtctcctca

SEQ ID NO: 5540 - DNA, 34 bp, Artificial Sequence
  Synthetic construct
tggagccagggaaccctggtcatcgtctcctcag

SEQ ID NO: 5541 - DNA, 33 bp, Artificial Sequence
  Synthetic construct
tggggcgatgggaccacggtcaccgtctcctca

SEQ ID NO: 5542 - DNA, 33 bp, Artificial Sequence
  Synthetic construct
tggggcagagggaccacggtcatcgtctcctca

SEQ ID NO: 5543 - DNA, 34 bp, Artificial Sequence
  Synthetic construct
tggggccagggaacccgggtcaccgtctcctcgg

SEQ ID NO: 5544 - DNA, 34 bp, Artificial Sequence
  Synthetic construct
tggggccaaggaggcctggtgaccgtcccctcag

SEQ ID NO: 5545 - DNA, 34 bp, Artificial Sequence
  Synthetic construct
tggggccagggaaccctgctcaccgtctcctcag

SEQ ID NO: 5546 - DNA, 34 bp, Artificial Sequence
  Synthetic construct
tggggccacgggacactggtcaccgtctcttcag

SEQ ID NO: 5547 - DNA, 34 bp, Artificial Sequence
  Synthetic construct
tggggccagggaatactggtcaccgtctcctcag

SEQ ID NO: 5548 - DNA, 33 bp, Artificial Sequence
  Synthetic construct
tggggcgaagggaccacggtcaccgtctcctca

SEQ ID NO: 5549 - DNA, 34 bp, Artificial Sequence
  Synthetic construct
tggggcctgggaacccttgtcaccgtctcctcag

SEQ ID NO: 5550 - DNA, 34 bp, Artificial Sequence
  Synthetic construct
tggggccagggaaccctggtcaatgtctcctcag

SEQ ID NO: 5551 - DNA, 34 bp, Artificial Sequence
  Synthetic construct
tggggccagggagccccggtcaccgtctcctcag

SEQ ID NO: 5552 - DNA, 34 bp, Artificial Sequence
  Synthetic construct
tggggccagggaagcctggtcaccatctcctccg

SEQ ID NO: 5553 - DNA, 34 bp, Artificial Sequence
  Synthetic construct
tggggccagggactcctggtcaccgtctccccag

SEQ ID NO: 5554 - DNA, 34 bp, Artificial Sequence
  Synthetic construct
tggggccagggaaccctggtgaccgtctccgcag

SEQ ID NO: 5555 - DNA, 33 bp, Artificial Sequence
  Synthetic construct
tggggcaaggggaccgcggtcaccgtctcctca

SEQ ID NO: 5556 - DNA, 34 bp, Artificial Sequence
  Synthetic construct
tggggccagggaaccctggtcaccgtctcctcct

SEQ ID NO: 5557 - DNA, 34 bp, Artificial Sequence
  Synthetic construct
tggggccagggaaccctagtcaccgtctcctcag

SEQ ID NO: 5558 - DNA, 34 bp, Artificial Sequence
  Synthetic construct
tggggccggggatcccaggtcattgtctcctcag

SEQ ID NO: 5559 - DNA, 34 bp, Artificial Sequence
  Synthetic construct
tggggccacgggacaagggtcaccgtctcttcag

SEQ ID NO: 5560 - DNA, 33 bp, Artificial Sequence
  Synthetic construct
tggggcacagggaccacggtcatcgtctcctca

SEQ ID NO: 5561 - DNA, 34 bp, Artificial Sequence
  Synthetic construct
tggggccaagggacaatggtcaccgtctctccag

SEQ ID NO: 5562 - DNA, 34 bp, Artificial Sequence
  Synthetic construct
tggggccagggaatcctggtcatcgtctcctcag

SEQ ID NO: 5563 - DNA, 34 bp, Artificial Sequence
  Synthetic construct
tggggccagggaaccctggtcactgtctcctcgg

SEQ ID NO: 5564 - DNA, 33 bp, Artificial Sequence
  Synthetic construct
tggggcagagggaccacggtcaccgtctcctca

SEQ ID NO: 5565 - DNA, 34 bp, Artificial Sequence
  Synthetic construct
tggggccgtggcaccctggtcacggtctcctcag

SEQ ID NO: 5566 - DNA, 34 bp, Artificial Sequence
  Synthetic construct
tggggccagggaaccctggtcgccgtctcctcaa

SEQ ID NO: 5567 - DNA, 34 bp, Artificial Sequence
  Synthetic construct
tggggccagggaacccgggtcaacgtctcttcag

SEQ ID NO: 5568 - DNA, 34 bp, Artificial Sequence
  Synthetic construct
tggggccagggaatcccggtcaccgtctcgtcag

SEQ ID NO: 5569 - DNA, 34 bp, Artificial Sequence
  Synthetic construct
tggggccaagggacattggtcagcgtctcttcag

SEQ ID NO: 5570 - DNA, 33 bp, Artificial Sequence
  Synthetic construct
tggggcaccgggacaacggtgaccgtctcctca

SEQ ID NO: 5571 - DNA, 33 bp, Artificial Sequence
  Synthetic construct
tggggcggagggaccagtgtcaccgtctcctca

SEQ ID NO: 5572 - DNA, 34 bp, Artificial Sequence
  Synthetic construct
tggggccagggaaccctggtcgccgtctcctcag

SEQ ID NO: 5573 - DNA, 34 bp, Artificial Sequence
  Synthetic construct
tggggtctggggacaaaggtcaccgtcgcttcag

SEQ ID NO: 5574 - DNA, 34 bp, Artificial Sequence
  Synthetic construct
tggggccaagggacactggtcatcgtctcttcag

SEQ ID NO: 5575 - DNA, 34 bp, Artificial Sequence
  Synthetic construct
tggggccagggaaccctggtcaccgtcacctcaa

SEQ ID NO: 5576 - DNA, 34 bp, Artificial Sequence
  Synthetic construct
tggggccacgggacaatggtcatcgtctcttcag

SEQ ID NO: 5577 - DNA, 24 bp, Artificial Sequence
  Synthetic construct
gattacagttttaccacctatgga

SEQ ID NO: 5578 - DNA, 24 bp, Artificial Sequence
  Synthetic construct
ggatacaccttcaccggtttctac

SEQ ID NO: 5579 - DNA, 24 bp, Artificial Sequence
  Synthetic construct
ggaggcaccttcggcagctctgct

SEQ ID NO: 5580 - DNA, 24 bp, Artificial Sequence
  Synthetic construct
gggttcatgttcagtggttctact

SEQ ID NO: 5581 - DNA, 24 bp, Artificial Sequence
  Synthetic construct
ggattcaccttcagtagctatggc

SEQ ID NO: 5582 - DNA, 24 bp, Artificial Sequence
  Synthetic construct
ggattcaccttcgatagttatggc

SEQ ID NO: 5583 - DNA, 24 bp, Artificial Sequence
  Synthetic construct
ggcttcaccttcagtggctctgct

SEQ ID NO: 5584 - DNA, 24 bp, Artificial Sequence
  Synthetic construct
gggttctccttcagtggctcggct

SEQ ID NO: 5585 - DNA, 24 bp, Artificial Sequence
  Synthetic construct
gggttcaccttcagtgagtctgca

SEQ ID NO: 5586 - DNA, 24 bp, Artificial Sequence
  Synthetic construct
ggatacaccttcaccgactactac

SEQ ID NO: 5587 - DNA, 24 bp, Artificial Sequence
  Synthetic construct
ggatacaccttcaccagttactat

SEQ ID NO: 5588 - DNA, 24 bp, Artificial Sequence
  Synthetic construct
ggatacaccttcaccgcctactac

SEQ ID NO: 5589 - DNA, 24 bp, Artificial Sequence
  Synthetic construct
ggatacacctacagcggctactat

SEQ ID NO: 5590 - DNA, 24 bp, Artificial Sequence
  Synthetic construct
ggatacaccttcacaaactatgct

SEQ ID NO: 5591 - DNA, 24 bp, Artificial Sequence
  Synthetic construct
ggatacaccttcatcggctattat

SEQ ID NO: 5592 - DNA, 24 bp, Artificial Sequence
  Synthetic construct
ggctacactttcatcgataaccct

SEQ ID NO: 5593 - DNA, 24 bp, Artificial Sequence
  Synthetic construct
ggattcaccctcagtgactctgtt

SEQ ID NO: 5594 - DNA, 24 bp, Artificial Sequence
  Synthetic construct
ggatacaccttcaccggctactac

SEQ ID NO: 5595 - DNA, 21 bp, Artificial Sequence
  Synthetic construct
ggagacgccttcagttatggt

SEQ ID NO: 5596 - DNA, 24 bp, Artificial Sequence
  Synthetic construct
gcatacaccttcagtaactatgct

SEQ ID NO: 5597 - DNA, 24 bp, Artificial Sequence
  Synthetic construct
ggatacaccttcattagctatgct

SEQ ID NO: 5598 - DNA, 24 bp, Artificial Sequence
  Synthetic construct
ggatacaccttcaccggctacttt

SEQ ID NO: 5599 - DNA, 24 bp, Artificial Sequence
  Synthetic construct
ggatactccttcaccgactacccc

SEQ ID NO: 5600 - DNA, 24 bp, Artificial Sequence
  Synthetic construct
ggatacattttcaccgactactac

SEQ ID NO: 5601 - DNA, 24 bp, Artificial Sequence
  Synthetic construct
gaatacatcttcagtaactatgtt

SEQ ID NO: 5602 - DNA, 24 bp, Artificial Sequence
  Synthetic construct
ggatacaccttcaccaaccatgat

SEQ ID NO: 5603 - DNA, 24 bp, Artificial Sequence
  Synthetic construct
ggatacacgttcaccaactatgat

SEQ ID NO: 5604 - DNA, 24 bp, Artificial Sequence
  Synthetic construct
ggatacaccttcaccagctatgat

SEQ ID NO: 5605 - DNA, 24 bp, Artificial Sequence
  Synthetic construct
ggatacaacttcgtcagctatgat

SEQ ID NO: 5606 - DNA, 24 bp, Artificial Sequence
  Synthetic construct
ggatacacctttctcaactatgat

SEQ ID NO: 5607 - DNA, 24 bp, Artificial Sequence
  Synthetic construct
ggatacaccttcactagctttgat

SEQ ID NO: 5608 - DNA, 24 bp, Artificial Sequence
  Synthetic construct
ggagacaccttcagcagttttgct

SEQ ID NO: 5609 - DNA, 24 bp, Artificial Sequence
  Synthetic construct
ggaggcaccttcagtagtgatgct

SEQ ID NO: 5610 - DNA, 24 bp, Artificial Sequence
  Synthetic construct
ggttacacttttaccagctatggt

SEQ ID NO: 5611 - DNA, 24 bp, Artificial Sequence
  Synthetic construct
ggaggcaccttcagcaactatgct

SEQ ID NO: 5612 - DNA, 24 bp, Artificial Sequence
  Synthetic construct
ggataccccttcagcgactatgat

SEQ ID NO: 5613 - DNA, 24 bp, Artificial Sequence
  Synthetic construct
ggatacagtttcacgacctatgct

SEQ ID NO: 5614 - DNA, 24 bp, Artificial Sequence
  Synthetic construct
ggaggcaccttcagcagctattct

SEQ ID NO: 5615 - DNA, 24 bp, Artificial Sequence
  Synthetic construct
ggaggctccttcagcagctttgct

SEQ ID NO: 5616 - DNA, 24 bp, Artificial Sequence
  Synthetic construct
agaggcaccttcagcagctatgct

SEQ ID NO: 5617 - DNA, 24 bp, Artificial Sequence
  Synthetic construct
ggttacacctttaccgactatggt

SEQ ID NO: 5618 - DNA, 24 bp, Artificial Sequence
  Synthetic construct
ggttacacccttaacaactatggt

SEQ ID NO: 5619 - DNA, 24 bp, Artificial Sequence
  Synthetic construct
ggaggcaccttcagcagccatgct

SEQ ID NO: 5620 - DNA, 24 bp, Artificial Sequence
  Synthetic construct
ggtttcaccatttccagttatggt

SEQ ID NO: 5621 - DNA, 24 bp, Artificial Sequence
  Synthetic construct
ggttacaccttaacaagttatggt

SEQ ID NO: 5622 - DNA, 24 bp, Artificial Sequence
  Synthetic construct
ggagacaccttcaacaattatgtt

SEQ ID NO: 5623 - DNA, 24 bp, Artificial Sequence
  Synthetic construct
ggggtgacatctagtaactacccc

SEQ ID NO: 5624 - DNA, 24 bp, Artificial Sequence
  Synthetic construct
ggaggcaccttcagcagtttttcc

SEQ ID NO: 5625 - DNA, 24 bp, Artificial Sequence
  Synthetic construct
ggttacaccttcaccaactttggt

SEQ ID NO: 5626 - DNA, 24 bp, Artificial Sequence
  Synthetic construct
ggaggcaccttcagcagttttgct

SEQ ID NO: 5627 - DNA, 24 bp, Artificial Sequence
  Synthetic construct
ggaggcatgttcaattcctatgct

SEQ ID NO: 5628 - DNA, 24 bp, Artificial Sequence
  Synthetic construct
ggaggcaccttcagcagctatgca

SEQ ID NO: 5629 - DNA, 24 bp, Artificial Sequence
  Synthetic construct
ggaggcaccttcagcagctatgct

SEQ ID NO: 5630 - DNA, 24 bp, Artificial Sequence
  Synthetic construct
ggaggaaccttcagcagctatagt

SEQ ID NO: 5631 - DNA, 24 bp, Artificial Sequence
  Synthetic construct
ggaggcacctttagcagttatgct

SEQ ID NO: 5632 - DNA, 24 bp, Artificial Sequence
  Synthetic construct
ggttacacctttaggaactatggt

SEQ ID NO: 5633 - DNA, 24 bp, Artificial Sequence
  Synthetic construct
ggttacagcttttccagttatggt

SEQ ID NO: 5634 - DNA, 24 bp, Artificial Sequence
  Synthetic construct
ggttacagctttaccaactatggt

SEQ ID NO: 5635 - DNA, 24 bp, Artificial Sequence
  Synthetic construct
ggttacacctttaccagctatggt

SEQ ID NO: 5636 - DNA, 24 bp, Artificial Sequence
  Synthetic construct
ggaggcgccttcagtgcctattca

SEQ ID NO: 5637 - DNA, 24 bp, Artificial Sequence
  Synthetic construct
ggttacacttttaccagttatggt

SEQ ID NO: 5638 - DNA, 24 bp, Artificial Sequence
  Synthetic construct
ggaggcgccttcagtaggtatgtt

SEQ ID NO: 5639 - DNA, 24 bp, Artificial Sequence
  Synthetic construct
ggaggcaccctcgggaactatgct

SEQ ID NO: 5640 - DNA, 24 bp, Artificial Sequence
  Synthetic construct
ggttatagcttttccagttttggc

SEQ ID NO: 5641 - DNA, 24 bp, Artificial Sequence
  Synthetic construct
ggaggcaacttcaacaaccttgtt

SEQ ID NO: 5642 - DNA, 24 bp, Artificial Sequence
  Synthetic construct
ggaggcaccttcagcacctctgga

SEQ ID NO: 5643 - DNA, 24 bp, Artificial Sequence
  Synthetic construct
ggctacactttcaatagatacggt

SEQ ID NO: 5644 - DNA, 24 bp, Artificial Sequence
  Synthetic construct
ggaggcaccttcagcaactctgct

SEQ ID NO: 5645 - DNA, 24 bp, Artificial Sequence
  Synthetic construct
ggttacacctttaccaactatggt

SEQ ID NO: 5646 - DNA, 24 bp, Artificial Sequence
  Synthetic construct
ggttacacctttatcaactatggt

SEQ ID NO: 5647 - DNA, 24 bp, Artificial Sequence
  Synthetic construct
ggaggcaccttcggctcctatgca

SEQ ID NO: 5648 - DNA, 24 bp, Artificial Sequence
  Synthetic construct
ggatacactttcactactcatgca

SEQ ID NO: 5649 - DNA, 24 bp, Artificial Sequence
  Synthetic construct
ggatacacattcaccgactactac

SEQ ID NO: 5650 - DNA, 24 bp, Artificial Sequence
  Synthetic construct
ggattcagcttcagtgaatttggc

SEQ ID NO: 5651 - DNA, 24 bp, Artificial Sequence
  Synthetic construct
ggatacaccttcaccgactacttc

SEQ ID NO: 5652 - DNA, 24 bp, Artificial Sequence
  Synthetic construct
ggaggcaccttcagcagctatggt

SEQ ID NO: 5653 - DNA, 24 bp, Artificial Sequence
  Synthetic construct
ggagagacgtccagcaactactat

SEQ ID NO: 5654 - DNA, 24 bp, Artificial Sequence
  Synthetic construct
ggatacaactttattgactactat

SEQ ID NO: 5655 - DNA, 24 bp, Artificial Sequence
  Synthetic construct
ggatacaacttcaatgaccacttc

SEQ ID NO: 5656 - DNA, 24 bp, Artificial Sequence
  Synthetic construct
gggtacaccctcactgacttagcc

SEQ ID NO: 5657 - DNA, 24 bp, Artificial Sequence
  Synthetic construct
ggaaaaaccctcactgaattactc

SEQ ID NO: 5658 - DNA, 24 bp, Artificial Sequence
  Synthetic construct
ggacacatcgtcagcagctatgag

SEQ ID NO: 5659 - DNA, 24 bp, Artificial Sequence
  Synthetic construct
ggatacaccttcaccgattactat

SEQ ID NO: 5660 - DNA, 24 bp, Artificial Sequence
  Synthetic construct
ggagaccccgtcaacaactatgcc

SEQ ID NO: 5661 - DNA, 24 bp, Artificial Sequence
  Synthetic construct
ggatacaccttcacttcctatgct

SEQ ID NO: 5662 - DNA, 24 bp, Artificial Sequence
  Synthetic construct
ggatacagctttaccagctactgg

SEQ ID NO: 5663 - DNA, 24 bp, Artificial Sequence
  Synthetic construct
ggatacagctttaccaactactgg

SEQ ID NO: 5664 - DNA, 24 bp, Artificial Sequence
  Synthetic construct
ggatattactttagtcaatactgg

SEQ ID NO: 5665 - DNA, 24 bp, Artificial Sequence
  Synthetic construct
ggcgacaggttaagcagtcactgg

SEQ ID NO: 5666 - DNA, 24 bp, Artificial Sequence
  Synthetic construct
ggatataattttagtagctactgg

SEQ ID NO: 5667 - DNA, 24 bp, Artificial Sequence
  Synthetic construct
ggatacagctttaccaaccactgg

SEQ ID NO: 5668 - DNA, 24 bp, Artificial Sequence
  Synthetic construct
ggatacagcttttccagttactgg

SEQ ID NO: 5669 - DNA, 24 bp, Artificial Sequence
  Synthetic construct
ggatacctctttggcagctattgg

SEQ ID NO: 5670 - DNA, 24 bp, Artificial Sequence
  Synthetic construct
ggatacaggtttaccagttactgg

SEQ ID NO: 5671 - DNA, 24 bp, Artificial Sequence
  Synthetic construct
ggatacagctttcccaattactgg

SEQ ID NO: 5672 - DNA, 24 bp, Artificial Sequence
  Synthetic construct
ggatacatttttaccgattactgg

SEQ ID NO: 5673 - DNA, 24 bp, Artificial Sequence
  Synthetic construct
ggatacagctttagcacatactgg

SEQ ID NO: 5674 - DNA, 24 bp, Artificial Sequence
  Synthetic construct
ggatacagctttagtagatattgg

SEQ ID NO: 5675 - DNA, 24 bp, Artificial Sequence
  Synthetic construct
ggatacagttttaccaattattgg

SEQ ID NO: 5676 - DNA, 24 bp, Artificial Sequence
  Synthetic construct
ggatacacctttaccagcctctgg

SEQ ID NO: 5677 - DNA, 24 bp, Artificial Sequence
  Synthetic construct
ggatatgactttaccgaccactgg

SEQ ID NO: 5678 - DNA, 24 bp, Artificial Sequence
  Synthetic construct
ggatacagttttaccaagtactgg

SEQ ID NO: 5679 - DNA, 24 bp, Artificial Sequence
  Synthetic construct
ggatacagctttaccacctactgg

SEQ ID NO: 5680 - DNA, 24 bp, Artificial Sequence
  Synthetic construct
ggatacagttttaccagttactgg

SEQ ID NO: 5681 - DNA, 24 bp, Artificial Sequence
  Synthetic construct
ggatatagctttcccaactactgg

SEQ ID NO: 5682 - DNA, 24 bp, Artificial Sequence
  Synthetic construct
ggatacgactttagcagccactgg

SEQ ID NO: 5683 - DNA, 24 bp, Artificial Sequence
  Synthetic construct
ggatacagtctcagtgattttggc

SEQ ID NO: 5684 - DNA, 24 bp, Artificial Sequence
  Synthetic construct
ggaggcaccttcagcaagtatgat

SEQ ID NO: 5685 - DNA, 24 bp, Artificial Sequence
  Synthetic construct
ggattcaccatcggtaattttgaa

SEQ ID NO: 5686 - DNA, 24 bp, Artificial Sequence
  Synthetic construct
ggactcacctttagcacctttgcc

SEQ ID NO: 5687 - DNA, 24 bp, Artificial Sequence
  Synthetic construct
ggactcaccttcagcagttctgaa

SEQ ID NO: 5688 - DNA, 24 bp, Artificial Sequence
  Synthetic construct
ggattcactttcagtaacgcctgg

SEQ ID NO: 5689 - DNA, 24 bp, Artificial Sequence
  Synthetic construct
ggattcagctttaaggactatgaa

SEQ ID NO: 5690 - DNA, 24 bp, Artificial Sequence
  Synthetic construct
ggaatcaccttcagtagttatggc

SEQ ID NO: 5691 - DNA, 24 bp, Artificial Sequence
  Synthetic construct
ggattcacctttagcgactatgcc

SEQ ID NO: 5692 - DNA, 24 bp, Artificial Sequence
  Synthetic construct
ggattcaccttcagtagttatgaa

SEQ ID NO: 5693 - DNA, 24 bp, Artificial Sequence
  Synthetic construct
ggattcacctttagcaactatgcc

SEQ ID NO: 5694 - DNA, 24 bp, Artificial Sequence
  Synthetic construct
ggattcacttttagcaattatgcc

SEQ ID NO: 5695 - DNA, 24 bp, Artificial Sequence
  Synthetic construct
gtattcaatttcagaagttatgaa

SEQ ID NO: 5696 - DNA, 24 bp, Artificial Sequence
  Synthetic construct
ggattcaccttcagtacctataac

SEQ ID NO: 5697 - DNA, 24 bp, Artificial Sequence
  Synthetic construct
ggattcaccttcagtgactataac

SEQ ID NO: 5698 - DNA, 24 bp, Artificial Sequence
  Synthetic construct
ggattcaacttcagtagctatagc

SEQ ID NO: 5699 - DNA, 24 bp, Artificial Sequence
  Synthetic construct
ggattcgccttcagtagctttagc

SEQ ID NO: 5700 - DNA, 24 bp, Artificial Sequence
  Synthetic construct
ggattcagcttcagtaactatacc

SEQ ID NO: 5701 - DNA, 24 bp, Artificial Sequence
  Synthetic construct
ggattcaacttcattagtcatacc

SEQ ID NO: 5702 - DNA, 24 bp, Artificial Sequence
  Synthetic construct
ggattcatcctcagtagatttagc

SEQ ID NO: 5703 - DNA, 24 bp, Artificial Sequence
  Synthetic construct
ggattcaccttcagttactatagc

SEQ ID NO: 5704 - DNA, 24 bp, Artificial Sequence
  Synthetic construct
ggattcaccttcagtagctatagc

SEQ ID NO: 5705 - DNA, 24 bp, Artificial Sequence
  Synthetic construct
ggtttcaccttcagcatgtacagt

SEQ ID NO: 5706 - DNA, 24 bp, Artificial Sequence
  Synthetic construct
ggattcatcttcagtgattatgaa

SEQ ID NO: 5707 - DNA, 24 bp, Artificial Sequence
  Synthetic construct
ggattcctcttcagaacttatgaa

SEQ ID NO: 5708 - DNA, 24 bp, Artificial Sequence
  Synthetic construct
ggattcaccttcagtagtaatgaa

SEQ ID NO: 5709 - DNA, 24 bp, Artificial Sequence
  Synthetic construct
ggattcagtttcaggagatatgac

SEQ ID NO: 5710 - DNA, 24 bp, Artificial Sequence
  Synthetic construct
ggattcaacttcagtcattattcc

SEQ ID NO: 5711 - DNA, 24 bp, Artificial Sequence
  Synthetic construct
ggattcaccttcagtagttttgaa

SEQ ID NO: 5712 - DNA, 24 bp, Artificial Sequence
  Synthetic construct
ggattcaccttcagtagttatgag

SEQ ID NO: 5713 - DNA, 24 bp, Artificial Sequence
  Synthetic construct
ggattcaccttcagtgattatgaa

SEQ ID NO: 5714 - DNA, 24 bp, Artificial Sequence
  Synthetic construct
gagttcaccttcagtaattatgaa

SEQ ID NO: 5715 - DNA, 24 bp, Artificial Sequence
  Synthetic construct
ggattcaccttcagtagttatacc

SEQ ID NO: 5716 - DNA, 24 bp, Artificial Sequence
  Synthetic construct
ggattcagcttcagtgcctatagc

SEQ ID NO: 5717 - DNA, 24 bp, Artificial Sequence
  Synthetic construct
ggcttctccttcggtgcttatggc

SEQ ID NO: 5718 - DNA, 24 bp, Artificial Sequence
  Synthetic construct
ggaggcaccttcagcagttatgct

SEQ ID NO: 5719 - DNA, 24 bp, Artificial Sequence
  Synthetic construct
ggattcagctttagtgactactac

SEQ ID NO: 5720 - DNA, 24 bp, Artificial Sequence
  Synthetic construct
ggattcaccttcagtgactattct

SEQ ID NO: 5721 - DNA, 24 bp, Artificial Sequence
  Synthetic construct
ggattcaccttcagcagcaatagc

SEQ ID NO: 5722 - DNA, 24 bp, Artificial Sequence
  Synthetic construct
ggattcaccttcagtgcattctac

SEQ ID NO: 5723 - DNA, 24 bp, Artificial Sequence
  Synthetic construct
ggattcatcttcagatcttatgca

SEQ ID NO: 5724 - DNA, 24 bp, Artificial Sequence
  Synthetic construct
ggattcattttcaatacttatgaa

SEQ ID NO: 5725 - DNA, 24 bp, Artificial Sequence
  Synthetic construct
ggattcaccttcaaaagttttgag

SEQ ID NO: 5726 - DNA, 24 bp, Artificial Sequence
  Synthetic construct
ggattcaatttcactaacgcctgg

SEQ ID NO: 5727 - DNA, 24 bp, Artificial Sequence
  Synthetic construct
ggattcaacttcagtagttatgaa

SEQ ID NO: 5728 - DNA, 24 bp, Artificial Sequence
  Synthetic construct
ggattcacctttagtagttatagt

SEQ ID NO: 5729 - DNA, 24 bp, Artificial Sequence
  Synthetic construct
ggatacaccttcactagctatgct

SEQ ID NO: 5730 - DNA, 24 bp, Artificial Sequence
  Synthetic construct
ggatccaccttcactacctatgct

SEQ ID NO: 5731 - DNA, 24 bp, Artificial Sequence
  Synthetic construct
ggatacagcttcaatatctatgct

SEQ ID NO: 5732 - DNA, 24 bp, Artificial Sequence
  Synthetic construct
ggatacagcttcatcacatatgct

SEQ ID NO: 5733 - DNA, 24 bp, Artificial Sequence
  Synthetic construct
ggatacaccttcactaattatgct

SEQ ID NO: 5734 - DNA, 24 bp, Artificial Sequence
  Synthetic construct
ggattcacctttggcgattatggc

SEQ ID NO: 5735 - DNA, 24 bp, Artificial Sequence
  Synthetic construct
ggattcagatttgatgattatgcc

SEQ ID NO: 5736 - DNA, 24 bp, Artificial Sequence
  Synthetic construct
ggattcacctttagcagatatgcc

SEQ ID NO: 5737 - DNA, 24 bp, Artificial Sequence
  Synthetic construct
ggattcacctttagcagctatgcc

SEQ ID NO: 5738 - DNA, 24 bp, Artificial Sequence
  Synthetic construct
gcattcatctttggtgattatgct

SEQ ID NO: 5739 - DNA, 24 bp, Artificial Sequence
  Synthetic construct
ggattcacctctggcacctatgcc

SEQ ID NO: 5740 - DNA, 24 bp, Artificial Sequence
  Synthetic construct
caattcacctttggcgactatgcc

SEQ ID NO: 5741 - DNA, 24 bp, Artificial Sequence
  Synthetic construct
ggaatcacttttagtaactattgg

SEQ ID NO: 5742 - DNA, 24 bp, Artificial Sequence
  Synthetic construct
ggattcacctttagaagctatggc

SEQ ID NO: 5743 - DNA, 24 bp, Artificial Sequence
  Synthetic construct
ggattcacgtttggcagttttgcc

SEQ ID NO: 5744 - DNA, 24 bp, Artificial Sequence
  Synthetic construct
ggattcacatttaacaattatgcc

SEQ ID NO: 5745 - DNA, 24 bp, Artificial Sequence
  Synthetic construct
ggattcatctttagtaactattgg

SEQ ID NO: 5746 - DNA, 24 bp, Artificial Sequence
  Synthetic construct
ggattcacctttagaagcttttgg

SEQ ID NO: 5747 - DNA, 24 bp, Artificial Sequence
  Synthetic construct
ggattcaccttcaatagttatgaa

SEQ ID NO: 5748 - DNA, 24 bp, Artificial Sequence
  Synthetic construct
ggattcacttttgacgactatgct

SEQ ID NO: 5749 - DNA, 24 bp, Artificial Sequence
  Synthetic construct
gaattcacttttggcgactatgcc

SEQ ID NO: 5750 - DNA, 24 bp, Artificial Sequence
  Synthetic construct
ggattcagttttacttcgttttgg

SEQ ID NO: 5751 - DNA, 24 bp, Artificial Sequence
  Synthetic construct
ggattcagttttgatgattatgcc

SEQ ID NO: 5752 - DNA, 24 bp, Artificial Sequence
  Synthetic construct
ggattcaggtttggtgaacattac

SEQ ID NO: 5753 - DNA, 24 bp, Artificial Sequence
  Synthetic construct
ggattcaccgtcactgaccaattc

SEQ ID NO: 5754 - DNA, 24 bp, Artificial Sequence
  Synthetic construct
ggattcaccttcagtggttcctac

SEQ ID NO: 5755 - DNA, 24 bp, Artificial Sequence
  Synthetic construct
ggattcaccttcggccgccatgcc

SEQ ID NO: 5756 - DNA, 24 bp, Artificial Sequence
  Synthetic construct
ggattcatcttcaataactatgcc

SEQ ID NO: 5757 - DNA, 24 bp, Artificial Sequence
  Synthetic construct
ggattcaccttcagtgactactac

SEQ ID NO: 5758 - DNA, 24 bp, Artificial Sequence
  Synthetic construct
ggattcaccttcggagactacgac

SEQ ID NO: 5759 - DNA, 24 bp, Artificial Sequence
  Synthetic construct
ggattcgacttcagtgactactac

SEQ ID NO: 5760 - DNA, 24 bp, Artificial Sequence
  Synthetic construct
ggattcaccttcagggactactac

SEQ ID NO: 5761 - DNA, 24 bp, Artificial Sequence
  Synthetic construct
ggattcaggtttgatgattatggc

SEQ ID NO: 5762 - DNA, 24 bp, Artificial Sequence
  Synthetic construct
ggattcaccttcagcggtgattca

SEQ ID NO: 5763 - DNA, 24 bp, Artificial Sequence
  Synthetic construct
ggattcacctttagcagctacgcc

SEQ ID NO: 5764 - DNA, 24 bp, Artificial Sequence
  Synthetic construct
ggagtcaacgtcagtagcaactac

SEQ ID NO: 5765 - DNA, 24 bp, Artificial Sequence
  Synthetic construct
ggattcactttcagaaacgcctgg

SEQ ID NO: 5766 - DNA, 24 bp, Artificial Sequence
  Synthetic construct
ggattcacctttggggattttgct

SEQ ID NO: 5767 - DNA, 24 bp, Artificial Sequence
  Synthetic construct
ggattcacctttggtgattatgct

SEQ ID NO: 5768 - DNA, 24 bp, Artificial Sequence
  Synthetic construct
ggcttcatcgtcactagcaactac

SEQ ID NO: 5769 - DNA, 24 bp, Artificial Sequence
  Synthetic construct
gggttcaccgtcactagcaactac

SEQ ID NO: 5770 - DNA, 24 bp, Artificial Sequence
  Synthetic construct
ggattcacctttatcaactatccc

SEQ ID NO: 5771 - DNA, 24 bp, Artificial Sequence
  Synthetic construct
ggattcacctttagcaactatggc

SEQ ID NO: 5772 - DNA, 24 bp, Artificial Sequence
  Synthetic construct
ggattcacatttgacatctatgcc

SEQ ID NO: 5773 - DNA, 24 bp, Artificial Sequence
  Synthetic construct
ggattcacctttgacaactatgcc

SEQ ID NO: 5774 - DNA, 24 bp, Artificial Sequence
  Synthetic construct
ggattcggctttagcagctttgcc

SEQ ID NO: 5775 - DNA, 24 bp, Artificial Sequence
  Synthetic construct
ggattcacctttagcacctatgcc

SEQ ID NO: 5776 - DNA, 24 bp, Artificial Sequence
  Synthetic construct
gggttcaccgtcagtagcaactac

SEQ ID NO: 5777 - DNA, 24 bp, Artificial Sequence
  Synthetic construct
gggttcaccgtcggtagcaactac

SEQ ID NO: 5778 - DNA, 24 bp, Artificial Sequence
  Synthetic construct
ggattcaccttcagtggctatagc

SEQ ID NO: 5779 - DNA, 24 bp, Artificial Sequence
  Synthetic construct
ggattcacctttagtacccattgg

SEQ ID NO: 5780 - DNA, 24 bp, Artificial Sequence
  Synthetic construct
ggattcacctttagtgactattgg

SEQ ID NO: 5781 - DNA, 24 bp, Artificial Sequence
  Synthetic construct
ggattcacctttagtagctattgg

SEQ ID NO: 5782 - DNA, 24 bp, Artificial Sequence
  Synthetic construct
ggattcacctttagtttctattgg

SEQ ID NO: 5783 - DNA, 18 bp, Artificial Sequence
  Synthetic construct
ggactcccccttggttgg

SEQ ID NO: 5784 - DNA, 24 bp, Artificial Sequence
  Synthetic construct
ggattcactttcagtaaggcctgg

SEQ ID NO: 5785 - DNA, 24 bp, Artificial Sequence
  Synthetic construct
ggtttcaaattcggtgattatgct

SEQ ID NO: 5786 - DNA, 24 bp, Artificial Sequence
  Synthetic construct
ggattcacctttagcacctatggc

SEQ ID NO: 5787 - DNA, 24 bp, Artificial Sequence
  Synthetic construct
ggattccactttagtagttattgg

SEQ ID NO: 5788 - DNA, 24 bp, Artificial Sequence
  Synthetic construct
gggctcaccgtcaccagaacctac

SEQ ID NO: 5789 - DNA, 24 bp, Artificial Sequence
  Synthetic construct
ggtttcacatttgggcactattgg

SEQ ID NO: 5790 - DNA, 24 bp, Artificial Sequence
  Synthetic construct
ggattcaccttcagtgattactac

SEQ ID NO: 5791 - DNA, 24 bp, Artificial Sequence
  Synthetic construct
gggttcacttttgatgatcatgca

SEQ ID NO: 5792 - DNA, 24 bp, Artificial Sequence
  Synthetic construct
ggattcacctttagttcctactgg

SEQ ID NO: 5793 - DNA, 24 bp, Artificial Sequence
  Synthetic construct
ggattcaccttcagtagttctgag

SEQ ID NO: 5794 - DNA, 24 bp, Artificial Sequence
  Synthetic construct
ggattcacctttggtgactacact

SEQ ID NO: 5795 - DNA, 24 bp, Artificial Sequence
  Synthetic construct
ggattcacctttaatatctttgcc

SEQ ID NO: 5796 - DNA, 24 bp, Artificial Sequence
  Synthetic construct
ggattcacctttagaatctttgcc

SEQ ID NO: 5797 - DNA, 24 bp, Artificial Sequence
  Synthetic construct
ggattcacctttagtagttattgg

SEQ ID NO: 5798 - DNA, 24 bp, Artificial Sequence
  Synthetic construct
ggattcacctttagtggctattgg

SEQ ID NO: 5799 - DNA, 24 bp, Artificial Sequence
  Synthetic construct
gcattcactttcagtaaggcctgg

SEQ ID NO: 5800 - DNA, 24 bp, Artificial Sequence
  Synthetic construct
ggattcacttttagtagatattgg

SEQ ID NO: 5801 - DNA, 24 bp, Artificial Sequence
  Synthetic construct
ggattcaccttcagtaattattgg

SEQ ID NO: 5802 - DNA, 24 bp, Artificial Sequence
  Synthetic construct
ggattcattttcaaaaatgcctgg

SEQ ID NO: 5803 - DNA, 24 bp, Artificial Sequence
  Synthetic construct
ggattcacttttaattcttattcc

SEQ ID NO: 5804 - DNA, 24 bp, Artificial Sequence
  Synthetic construct
ggagacaccttctttaactatgtt

SEQ ID NO: 5805 - DNA, 24 bp, Artificial Sequence
  Synthetic construct
ggattcacctttaacaattatggc

SEQ ID NO: 5806 - DNA, 24 bp, Artificial Sequence
  Synthetic construct
ggattcacctttaacaattatgcc

SEQ ID NO: 5807 - DNA, 24 bp, Artificial Sequence
  Synthetic construct
ggatttaccttcagtctctatgaa

SEQ ID NO: 5808 - DNA, 24 bp, Artificial Sequence
  Synthetic construct
ggattcatcttcagtgactatggc

SEQ ID NO: 5809 - DNA, 24 bp, Artificial Sequence
  Synthetic construct
ggattcaccttcagttactactgg

SEQ ID NO: 5810 - DNA, 24 bp, Artificial Sequence
  Synthetic construct
gggttcaccttcagtgactacacc

SEQ ID NO: 5811 - DNA, 24 bp, Artificial Sequence
  Synthetic construct
ggattcaccttcagtagctatgct

SEQ ID NO: 5812 - DNA, 24 bp, Artificial Sequence
  Synthetic construct
ggattcaccttcagcgattatggc

SEQ ID NO: 5813 - DNA, 24 bp, Artificial Sequence
  Synthetic construct
ggattcaccttcagtagttatggc

SEQ ID NO: 5814 - DNA, 14 bp, Artificial Sequence
  Synthetic construct
gggggagttcggcc

SEQ ID NO: 5815 - DNA, 24 bp, Artificial Sequence
  Synthetic construct
ggattcaccttcagcaaccatggc

SEQ ID NO: 5816 - DNA, 24 bp, Artificial Sequence
  Synthetic construct
gcattcaccttcaatgcctacggc

SEQ ID NO: 5817 - DNA, 24 bp, Artificial Sequence
  Synthetic construct
ggattctccttcagtagttatggc

SEQ ID NO: 5818 - DNA, 24 bp, Artificial Sequence
  Synthetic construct
ggattcaccttcagcacctatgcc

SEQ ID NO: 5819 - DNA, 24 bp, Artificial Sequence
  Synthetic construct
ggattcgtcttcagtagttatggc

SEQ ID NO: 5820 - DNA, 24 bp, Artificial Sequence
  Synthetic construct
ggattcagtttcagtaactatggc

SEQ ID NO: 5821 - DNA, 24 bp, Artificial Sequence
  Synthetic construct
ggattcaatttcacttcctatgcc

SEQ ID NO: 5822 - DNA, 24 bp, Artificial Sequence
  Synthetic construct
ggattcagcttcagaagctatggc

SEQ ID NO: 5823 - DNA, 24 bp, Artificial Sequence
  Synthetic construct
ggattcaccttcagttgctatggc

SEQ ID NO: 5824 - DNA, 18 bp, Artificial Sequence
  Synthetic construct
accttcagtaactatggc

SEQ ID NO: 5825 - DNA, 24 bp, Artificial Sequence
  Synthetic construct
ggattcaccttcaatagctatggc

SEQ ID NO: 5826 - DNA, 24 bp, Artificial Sequence
  Synthetic construct
ggattcaccttcagcaactatggc

SEQ ID NO: 5827 - DNA, 24 bp, Artificial Sequence
  Synthetic construct
ggactcgccttcagaaattatgtc

SEQ ID NO: 5828 - DNA, 24 bp, Artificial Sequence
  Synthetic construct
ggattcgccttcagtagctttggc

SEQ ID NO: 5829 - DNA, 24 bp, Artificial Sequence
  Synthetic construct
ggattcctgttcagtagctatgcc

SEQ ID NO: 5830 - DNA, 24 bp, Artificial Sequence
  Synthetic construct
ggattcaccttcgacagttatggc

SEQ ID NO: 5831 - DNA, 24 bp, Artificial Sequence
  Synthetic construct
ggattcaccttcaccacctatgcc

SEQ ID NO: 5832 - DNA, 24 bp, Artificial Sequence
  Synthetic construct
ggattcaccttcagtaactatgac

SEQ ID NO: 5833 - DNA, 24 bp, Artificial Sequence
  Synthetic construct
ggattccccctcagcaactacggc

SEQ ID NO: 5834 - DNA, 24 bp, Artificial Sequence
  Synthetic construct
gggttcaccttcagtaaccatggc

SEQ ID NO: 5835 - DNA, 24 bp, Artificial Sequence
  Synthetic construct
ggtttcacctttggcgcctatgac

SEQ ID NO: 5836 - DNA, 24 bp, Artificial Sequence
  Synthetic construct
ggattcaccttcagtaactatggc

SEQ ID NO: 5837 - DNA, 24 bp, Artificial Sequence
  Synthetic construct
gggttcagcttcagtggctctgct

SEQ ID NO: 5838 - DNA, 24 bp, Artificial Sequence
  Synthetic construct
ggattcacctttgatgattatggc

SEQ ID NO: 5839 - DNA, 24 bp, Artificial Sequence
  Synthetic construct
ggattcacctttgttgattttgcc

SEQ ID NO: 5840 - DNA, 24 bp, Artificial Sequence
  Synthetic construct
ggattcagtcttgatgattatgcc

SEQ ID NO: 5841 - DNA, 24 bp, Artificial Sequence
  Synthetic construct
ggattcacctttgatgattatgcc

SEQ ID NO: 5842 - DNA, 24 bp, Artificial Sequence
  Synthetic construct
ggattcatctttgatgattatgcc

SEQ ID NO: 5843 - DNA, 24 bp, Artificial Sequence
  Synthetic construct
ggattcacctttggtgattatgcc

SEQ ID NO: 5844 - DNA, 24 bp, Artificial Sequence
  Synthetic construct
ggatttacttttaaagattttgcc

SEQ ID NO: 5845 - DNA, 24 bp, Artificial Sequence
  Synthetic construct
ggatacaccttcacctcctaccac

SEQ ID NO: 5846 - DNA, 24 bp, Artificial Sequence
  Synthetic construct
ggatacaccttcaccagctactat

SEQ ID NO: 5847 - DNA, 24 bp, Artificial Sequence
  Synthetic construct
ggatacaccttcaccaggtactat

SEQ ID NO: 5848 - DNA, 24 bp, Artificial Sequence
  Synthetic construct
ggttacaccttcacttcctacttc

SEQ ID NO: 5849 - DNA, 24 bp, Artificial Sequence
  Synthetic construct
ggatacatcttcaccagcttcttt

SEQ ID NO: 5850 - DNA, 24 bp, Artificial Sequence
  Synthetic construct
ggatacaccttcaccggctactat

SEQ ID NO: 5851 - DNA, 24 bp, Artificial Sequence
  Synthetic construct
ggatacaccttcaatgcctactat

SEQ ID NO: 5852 - DNA, 24 bp, Artificial Sequence
  Synthetic construct
ggatataccttcaccggctactat

SEQ ID NO: 5853 - DNA, 24 bp, Artificial Sequence
  Synthetic construct
ggatacaccttcaccgactactat

SEQ ID NO: 5854 - DNA, 24 bp, Artificial Sequence
  Synthetic construct
ggatacaattttaccacatatcac

SEQ ID NO: 5855 - DNA, 24 bp, Artificial Sequence
  Synthetic construct
ggatacaccctcactgaattatcc

SEQ ID NO: 5856 - DNA, 24 bp, Artificial Sequence
  Synthetic construct
ggatacaccttcagtatttatgct

SEQ ID NO: 5857 - DNA, 24 bp, Artificial Sequence
  Synthetic construct
ggattcacctttactagctctgct

SEQ ID NO: 5858 - DNA, 24 bp, Artificial Sequence
  Synthetic construct
ggatctaacttcaaaaactttggc

SEQ ID NO: 5859 - DNA, 24 bp, Artificial Sequence
  Synthetic construct
ggatacaccttcactaggtatgct

SEQ ID NO: 5860 - DNA, 24 bp, Artificial Sequence
  Synthetic construct
ggatacaccttcacaagctatgct

SEQ ID NO: 5861 - DNA, 24 bp, Artificial Sequence
  Synthetic construct
ggatacaccttcattagttatgcc

SEQ ID NO: 5862 - DNA, 24 bp, Artificial Sequence
  Synthetic construct
ggatacaccttcaccgaccacttc

SEQ ID NO: 5863 - DNA, 24 bp, Artificial Sequence
  Synthetic construct
ggattcaccttcagtgcctataga

SEQ ID NO: 5864 - DNA, 24 bp, Artificial Sequence
  Synthetic construct
ggattcaccttcagtgaccactac

SEQ ID NO: 5865 - DNA, 24 bp, Artificial Sequence
  Synthetic construct
gggtttgccttcagccgctatggc

SEQ ID NO: 5866 - DNA, 24 bp, Artificial Sequence
  Synthetic construct
ggattcaggtttggtgattatgcc

SEQ ID NO: 5867 - DNA, 24 bp, Artificial Sequence
  Synthetic construct
gggttcaccgtcagcagctaccag

SEQ ID NO: 5868 - DNA, 24 bp, Artificial Sequence
  Synthetic construct
ggattcatgtttggtagttatgcc

SEQ ID NO: 5869 - DNA, 24 bp, Artificial Sequence
  Synthetic construct
ggattcaccttcaaagaccactat

SEQ ID NO: 5870 - DNA, 10 bp, Artificial Sequence
  Synthetic construct
ggacacctac

SEQ ID NO: 5871 - DNA, 24 bp, Artificial Sequence
  Synthetic construct
ggattcacctttagaaactattgg

SEQ ID NO: 5872 - DNA, 24 bp, Artificial Sequence
  Synthetic construct
ggattcatctttggcaactatgcc

SEQ ID NO: 5873 - DNA, 24 bp, Artificial Sequence
  Synthetic construct
ggattcaccttcagtacttatgag

SEQ ID NO: 5874 - DNA, 24 bp, Artificial Sequence
  Synthetic construct
ggattcatcctcagtgactatagc

SEQ ID NO: 5875 - DNA, 24 bp, Artificial Sequence
  Synthetic construct
ggattcaccttcagtaactactgg

SEQ ID NO: 5876 - DNA, 24 bp, Artificial Sequence
  Synthetic construct
ggattcagcataagtttttatgcc

SEQ ID NO: 5877 - DNA, 24 bp, Artificial Sequence
  Synthetic construct
ggattcaccgtcaatagcaactac

SEQ ID NO: 5878 - DNA, 24 bp, Artificial Sequence
  Synthetic construct
ggattcgcctttgttaaatacacg

SEQ ID NO: 5879 - DNA, 24 bp, Artificial Sequence
  Synthetic construct
ggattcacttttagtaactatgcc

SEQ ID NO: 5880 - DNA, 24 bp, Artificial Sequence
  Synthetic construct
ggaggcaccttcaatagtcatact

SEQ ID NO: 5881 - DNA, 24 bp, Artificial Sequence
  Synthetic construct
ggttacaccttcgacgagtatgat

SEQ ID NO: 5882 - DNA, 24 bp, Artificial Sequence
  Synthetic construct
ggaggcaccttcgacaactatgct

SEQ ID NO: 5883 - DNA, 24 bp, Artificial Sequence
  Synthetic construct
ggtctcaagtttgacaattcagca

SEQ ID NO: 5884 - DNA, 24 bp, Artificial Sequence
  Synthetic construct
ggatacaccttcaccgactactcc

SEQ ID NO: 5885 - DNA, 24 bp, Artificial Sequence
  Synthetic construct
ggatacaccttccccggccacttt

SEQ ID NO: 5886 - DNA, 24 bp, Artificial Sequence
  Synthetic construct
ggatacaccttcaccggccactat

SEQ ID NO: 5887 - DNA, 24 bp, Artificial Sequence
  Synthetic construct
ggatacaccttcagcgacttctac

SEQ ID NO: 5888 - DNA, 24 bp, Artificial Sequence
  Synthetic construct
ggatacaccttcgccgcctactct

SEQ ID NO: 5889 - DNA, 24 bp, Artificial Sequence
  Synthetic construct
ggatacacctttaccgcccactat

SEQ ID NO: 5890 - DNA, 24 bp, Artificial Sequence
  Synthetic construct
ggacacaccttcattgactatgct

SEQ ID NO: 5891 - DNA, 24 bp, Artificial Sequence
  Synthetic construct
ggattcacctttaacacctatgcc

SEQ ID NO: 5892 - DNA, 24 bp, Artificial Sequence
  Synthetic construct
ggatactccttcacccccttctat

SEQ ID NO: 5893 - DNA, 24 bp, Artificial Sequence
  Synthetic construct
ggatacagtttcgccagttatggc

SEQ ID NO: 5894 - DNA, 24 bp, Artificial Sequence
  Synthetic construct
ggagggaccttcaggagtcactat

SEQ ID NO: 5895 - DNA, 24 bp, Artificial Sequence
  Synthetic construct
ggagacgccttcagcagccatgct

SEQ ID NO: 5896 - DNA, 24 bp, Artificial Sequence
  Synthetic construct
ggaggcaccctcagcgacttatct

SEQ ID NO: 5897 - DNA, 24 bp, Artificial Sequence
  Synthetic construct
ggaggctccttcagcggctttggt

SEQ ID NO: 5898 - DNA, 24 bp, Artificial Sequence
  Synthetic construct
ggattcaacttctattcctatacc

SEQ ID NO: 5899 - DNA, 24 bp, Artificial Sequence
  Synthetic construct
ggattcaccttcagtaattatgaa

SEQ ID NO: 5900 - DNA, 24 bp, Artificial Sequence
  Synthetic construct
ggattcacatttagttccttttgg

SEQ ID NO: 5901 - DNA, 24 bp, Artificial Sequence
  Synthetic construct
ggattcactttttccatttatgcc

SEQ ID NO: 5902 - DNA, 24 bp, Artificial Sequence
  Synthetic construct
ggattcacctttagttccttttgg

SEQ ID NO: 5903 - DNA, 24 bp, Artificial Sequence
  Synthetic construct
ggattcaagtttggtgattatggt

SEQ ID NO: 5904 - DNA, 24 bp, Artificial Sequence
  Synthetic construct
ggatttactttcgacaccgcctgg

SEQ ID NO: 5905 - DNA, 24 bp, Artificial Sequence
  Synthetic construct
agatcctctttcagtgacgactgg

SEQ ID NO: 5906 - DNA, 24 bp, Artificial Sequence
  Synthetic construct
gggttcatctttggtgattatgcg

SEQ ID NO: 5907 - DNA, 24 bp, Artificial Sequence
  Synthetic construct
ggatacaccttcaccgaccactat

SEQ ID NO: 5908 - DNA, 24 bp, Artificial Sequence
  Synthetic construct
ggattcacgttccgtaattatggc

SEQ ID NO: 5909 - DNA, 30 bp, Artificial Sequence
  Synthetic construct
gaagtctctcaaaattctaatgcagcgggt

SEQ ID NO: 5910 - DNA, 24 bp, Artificial Sequence
  Synthetic construct
ggttacacctttaccagttatagt

SEQ ID NO: 5911 - DNA, 24 bp, Artificial Sequence
  Synthetic construct
ggattcacctttagttcgtatggc

SEQ ID NO: 5912 - DNA, 24 bp, Artificial Sequence
  Synthetic construct
ggattcaccctcagaaattatgct

SEQ ID NO: 5913 - DNA, 24 bp, Artificial Sequence
  Synthetic construct
ggatacaccctctccacctatgat

SEQ ID NO: 5914 - DNA, 24 bp, Artificial Sequence
  Synthetic construct
ggaggcaccttcatcagttatagt

SEQ ID NO: 5915 - DNA, 24 bp, Artificial Sequence
  Synthetic construct
ggaggcaccctcaccgactactct

SEQ ID NO: 5916 - DNA, 24 bp, Artificial Sequence
  Synthetic construct
ggaggcaccctcagcacctatggt

SEQ ID NO: 5917 - DNA, 24 bp, Artificial Sequence
  Synthetic construct
ggggggaacttcagcaggaccgtt

SEQ ID NO: 5918 - DNA, 30 bp, Artificial Sequence
  Synthetic construct
gcgttctcactcagcaatgttaaaatgggt

SEQ ID NO: 5919 - DNA, 30 bp, Artificial Sequence
  Synthetic construct
gggttctcactcagcactagtggaatgtgt

SEQ ID NO: 5920 - DNA, 24 bp, Artificial Sequence
  Synthetic construct
ggggtctccgtcatcaacgatgca

SEQ ID NO: 5921 - DNA, 24 bp, Artificial Sequence
  Synthetic construct
ggttacgccttaagtgattatggt

SEQ ID NO: 5922 - DNA, 24 bp, Artificial Sequence
  Synthetic construct
ggatatagttttaccagttactgg

SEQ ID NO: 5923 - DNA, 24 bp, Artificial Sequence
  Synthetic construct
ggatatagttttgcgacatactgg

SEQ ID NO: 5924 - DNA, 24 bp, Artificial Sequence
  Synthetic construct
gctgcgtcattcagtggtaattac

SEQ ID NO: 5925 - DNA, 24 bp, Artificial Sequence
  Synthetic construct
gggttcagcgtcagtgaccatcac

SEQ ID NO: 5926 - DNA, 24 bp, Artificial Sequence
  Synthetic construct
ggattcatttttggtgattatgct

SEQ ID NO: 5927 - DNA, 30 bp, Artificial Sequence
  Synthetic construct
gggttctcagtcagcaccagtggaatgtgt

SEQ ID NO: 5928 - DNA, 30 bp, Artificial Sequence
  Synthetic construct
ggattctcactcagcactagtggaatgtgt

SEQ ID NO: 5929 - DNA, 30 bp, Artificial Sequence
  Synthetic construct
gggttctcactcaccaatgctagaatgggt

SEQ ID NO: 5930 - DNA, 30 bp, Artificial Sequence
  Synthetic construct
ggtttctcactcacgacatctggaatgtgt

SEQ ID NO: 5931 - DNA, 30 bp, Artificial Sequence
  Synthetic construct
gggttctcactcaacactagtggaatgtgt

SEQ ID NO: 5932 - DNA, 30 bp, Artificial Sequence
  Synthetic construct
ggcttctcactcagcgatcctagaatgggt

SEQ ID NO: 5933 - DNA, 24 bp, Artificial Sequence
  Synthetic construct
gggttcaccttaagtgatcattct

SEQ ID NO: 5934 - DNA, 30 bp, Artificial Sequence
  Synthetic construct
gggttctcactcaccactagaggaatgtgt

SEQ ID NO: 5935 - DNA, 24 bp, Artificial Sequence
  Synthetic construct
ggattcactttttacaactacgcc

SEQ ID NO: 5936 - DNA, 30 bp, Artificial Sequence
  Synthetic construct
gggttctcattcagtactagtggaatgtct

SEQ ID NO: 5937 - DNA, 30 bp, Artificial Sequence
  Synthetic construct
ggggtctcactcgatagtagtggagtggct

SEQ ID NO: 5938 - DNA, 30 bp, Artificial Sequence
  Synthetic construct
gggttctcactcagttctattggagaggct

SEQ ID NO: 5939 - DNA, 30 bp, Artificial Sequence
  Synthetic construct
gggttctcactcaggactagtggagtgggt

SEQ ID NO: 5940 - DNA, 30 bp, Artificial Sequence
  Synthetic construct
gggttctcactcagcactagtggagtgggt

SEQ ID NO: 5941 - DNA, 30 bp, Artificial Sequence
  Synthetic construct
ggattctcattcaggtctagtgcagtgggt

SEQ ID NO: 5942 - DNA, 30 bp, Artificial Sequence
  Synthetic construct
gggtcctcactcggtactagtggagcgggt

SEQ ID NO: 5943 - DNA, 30 bp, Artificial Sequence
  Synthetic construct
gggttctcactcagcactcgtggagtgggt

SEQ ID NO: 5944 - DNA, 24 bp, Artificial Sequence
  Synthetic construct
ggcttcacgtttagcagttatgcc

SEQ ID NO: 5945 - DNA, 24 bp, Artificial Sequence
  Synthetic construct
ggattcatcctcagtagttttgag

SEQ ID NO: 5946 - DNA, 24 bp, Artificial Sequence
  Synthetic construct
ggtggctccatcagtagtttctac

SEQ ID NO: 5947 - DNA, 30 bp, Artificial Sequence
  Synthetic construct
ggggacagtgtctctagcaacagtgctgct

SEQ ID NO: 5948 - DNA, 30 bp, Artificial Sequence
  Synthetic construct
ggtggctccgtcagcggtggtgattactcc

SEQ ID NO: 5949 - DNA, 24 bp, Artificial Sequence
  Synthetic construct
ggtggctccatcagtactcaatac

SEQ ID NO: 5950 - DNA, 24 bp, Artificial Sequence
  Synthetic construct
ggtgagtctttcagtgcttacttc

SEQ ID NO: 5951 - DNA, 24 bp, Artificial Sequence
  Synthetic construct
ggtggctccatcagtacttactac

SEQ ID NO: 5952 - DNA, 24 bp, Artificial Sequence
  Synthetic construct
ggtgactccatcactaataactac

SEQ ID NO: 5953 - DNA, 30 bp, Artificial Sequence
  Synthetic construct
ggtgactccatcagcagtagtacttattac

SEQ ID NO: 5954 - DNA, 30 bp, Artificial Sequence
  Synthetic construct
ggtgactccatgaacaggagtggttactac

SEQ ID NO: 5955 - DNA, 30 bp, Artificial Sequence
  Synthetic construct
ggtggctccttcagcagtggtagttactac

SEQ ID NO: 5956 - DNA, 30 bp, Artificial Sequence
  Synthetic construct
ggtggctccatcagcagtggtagttattac

SEQ ID NO: 5957 - DNA, 24 bp, Artificial Sequence
  Synthetic construct
ggaggctccatcagtggctactac

SEQ ID NO: 5958 - DNA, 24 bp, Artificial Sequence
  Synthetic construct
ggtgactccatcactagttactac

SEQ ID NO: 5959 - DNA, 24 bp, Artificial Sequence
  Synthetic construct
ggggactccaccagaagttattat

SEQ ID NO: 5960 - DNA, 24 bp, Artificial Sequence
  Synthetic construct
agtgtctccctgaatgattattat

SEQ ID NO: 5961 - DNA, 24 bp, Artificial Sequence
  Synthetic construct
ggtgggtccttcagtggttactac

SEQ ID NO: 5962 - DNA, 24 bp, Artificial Sequence
  Synthetic construct
ggtggctccatcaatacttactac

SEQ ID NO: 5963 - DNA, 24 bp, Artificial Sequence
  Synthetic construct
ggtggctccatcagtagttactac

SEQ ID NO: 5964 - DNA, 24 bp, Artificial Sequence
  Synthetic construct
ggtgactccatcagtacttactac

SEQ ID NO: 5965 - DNA, 24 bp, Artificial Sequence
  Synthetic construct
ggtgcctccatcaattatttctac

SEQ ID NO: 5966 - DNA, 30 bp, Artificial Sequence
  Synthetic construct
ggtgactcaatcagcagtggtttttatcac

SEQ ID NO: 5967 - DNA, 30 bp, Artificial Sequence
  Synthetic construct
ggtggctccatcagcagtggtagttactac

SEQ ID NO: 5968 - DNA, 30 bp, Artificial Sequence
  Synthetic construct
ggtggctccatcagcagtagtaactactac

SEQ ID NO: 5969 - DNA, 30 bp, Artificial Sequence
  Synthetic construct
gggggctccatcaggggtgataattactac

SEQ ID NO: 5970 - DNA, 24 bp, Artificial Sequence
  Synthetic construct
ggcgcctccatgactagttactac

SEQ ID NO: 5971 - DNA, 24 bp, Artificial Sequence
  Synthetic construct
ggtggctccatgagtagttactac

SEQ ID NO: 5972 - DNA, 30 bp, Artificial Sequence
  Synthetic construct
ggtggctccatcagcagtgggagtcactac

SEQ ID NO: 5973 - DNA, 30 bp, Artificial Sequence
  Synthetic construct
ggtgcctctctcacgaacccgtctttttac

SEQ ID NO: 5974 - DNA, 24 bp, Artificial Sequence
  Synthetic construct
ggtgattccttcagtgattactac

SEQ ID NO: 5975 - DNA, 24 bp, Artificial Sequence
  Synthetic construct
ggtgggtccttcagaggtttcttc

SEQ ID NO: 5976 - DNA, 24 bp, Artificial Sequence
  Synthetic construct
ggtgcgtccttcaacatttattct

SEQ ID NO: 5977 - DNA, 24 bp, Artificial Sequence
  Synthetic construct
cgtgggtcgttaagtgctcactat

SEQ ID NO: 5978 - DNA, 24 bp, Artificial Sequence
  Synthetic construct
ggtgggtccttcaatgattactac

SEQ ID NO: 5979 - DNA, 24 bp, Artificial Sequence
  Synthetic construct
tatgggtccttcagtggttactcc

SEQ ID NO: 5980 - DNA, 24 bp, Artificial Sequence
  Synthetic construct
cgtgggtccttcagagatcactac

SEQ ID NO: 5981 - DNA, 24 bp, Artificial Sequence
  Synthetic construct
ggtgggtccttcagtggttacttc

SEQ ID NO: 5982 - DNA, 24 bp, Artificial Sequence
  Synthetic construct
ggtggctccatcagcaacttctac

SEQ ID NO: 5983 - DNA, 30 bp, Artificial Sequence
  Synthetic construct
ggtgactccatcagcagtggtggttactcc

SEQ ID NO: 5984 - DNA, 30 bp, Artificial Sequence
  Synthetic construct
ggtggctccatcagcagtggtggttactcc

SEQ ID NO: 5985 - DNA, 30 bp, Artificial Sequence
  Synthetic construct
ggtgactccgtcaacagtggtgcttactcc

SEQ ID NO: 5986 - DNA, 24 bp, Artificial Sequence
  Synthetic construct
ggtggctccatcaggagtcactac

SEQ ID NO: 5987 - DNA, 24 bp, Artificial Sequence
  Synthetic construct
ggtgactccatcagtggttaccac

SEQ ID NO: 5988 - DNA, 24 bp, Artificial Sequence
  Synthetic construct
ggtggctccaccaggagttactac

SEQ ID NO: 5989 - DNA, 24 bp, Artificial Sequence
  Synthetic construct
gatggctccatcaatagttactac

SEQ ID NO: 5990 - DNA, 24 bp, Artificial Sequence
  Synthetic construct
ggtggctccatcagtggttactac

SEQ ID NO: 5991 - DNA, 24 bp, Artificial Sequence
  Synthetic construct
ggtgactccatcagtaattactac

SEQ ID NO: 5992 - DNA, 30 bp, Artificial Sequence
  Synthetic construct
ggtggctccatcaacagcggtaattactac

SEQ ID NO: 5993 - DNA, 30 bp, Artificial Sequence
  Synthetic construct
ggtgactccgtcagcagtggtacttactcc

SEQ ID NO: 5994 - DNA, 30 bp, Artificial Sequence
  Synthetic construct
ggtggctccatcagcagtggcagttactac

SEQ ID NO: 5995 - DNA, 30 bp, Artificial Sequence
  Synthetic construct
ggtggctccatcagaagtgatagttcctac

SEQ ID NO: 5996 - DNA, 24 bp, Artificial Sequence
  Synthetic construct
ggtggttccataagaaattattac

SEQ ID NO: 5997 - DNA, 24 bp, Artificial Sequence
  Synthetic construct
ggcggccccagcgatagttcctac

SEQ ID NO: 5998 - DNA, 24 bp, Artificial Sequence
  Synthetic construct
ggtgcctccatcagtcgttactat

SEQ ID NO: 5999 - DNA, 24 bp, Artificial Sequence
  Synthetic construct
ggtggctccttcagtgattacgac

SEQ ID NO: 6000 - DNA, 24 bp, Artificial Sequence
  Synthetic construct
ggtggctccatcagtacctactac

SEQ ID NO: 6001 - DNA, 24 bp, Artificial Sequence
  Synthetic construct
ggtggctctattacttctaactac

SEQ ID NO: 6002 - DNA, 24 bp, Artificial Sequence
  Synthetic construct
ggtgggtccttcagttcttactcc

SEQ ID NO: 6003 - DNA, 24 bp, Artificial Sequence
  Synthetic construct
ggtgagtccttcattgggtactac

SEQ ID NO: 6004 - DNA, 24 bp, Artificial Sequence
  Synthetic construct
ggtgggtccttcagtgattactac

SEQ ID NO: 6005 - DNA, 30 bp, Artificial Sequence
  Synthetic construct
ggtgactccatcagtggtaatacttattcc

SEQ ID NO: 6006 - DNA, 24 bp, Artificial Sequence
  Synthetic construct
ggtggctccatcagtaatcactac

SEQ ID NO: 6007 - DNA, 24 bp, Artificial Sequence
  Synthetic construct
aatggctccgtcagcagtaacttc

SEQ ID NO: 6008 - DNA, 24 bp, Artificial Sequence
  Synthetic construct
ggtggtgccttcagtgactactac

SEQ ID NO: 6009 - DNA, 24 bp, Artificial Sequence
  Synthetic construct
ggtggctccatcagtgggtacttc

SEQ ID NO: 6010 - DNA, 30 bp, Artificial Sequence
  Synthetic construct
ggtgcctccgtcaacactggtaatttctat

SEQ ID NO: 6011 - DNA, 27 bp, Artificial Sequence
  Synthetic construct
ggtccctccatcaacagttcttactcc

SEQ ID NO: 6012 - DNA, 30 bp, Artificial Sequence
  Synthetic construct
ggtggctccatcagggttgacacattctac

SEQ ID NO: 6013 - DNA, 30 bp, Artificial Sequence
  Synthetic construct
ggtggctccatcagcagtagtagttactac

SEQ ID NO: 6014 - DNA, 30 bp, Artificial Sequence
  Synthetic construct
ggtggctccatcagcagtagtaattactat

SEQ ID NO: 6015 - DNA, 30 bp, Artificial Sequence
  Synthetic construct
ggtggctccatcagcggtactagtgactac

SEQ ID NO: 6016 - DNA, 30 bp, Artificial Sequence
  Synthetic construct
ggtggctccatcagcagtaatagttactac

SEQ ID NO: 6017 - DNA, 30 bp, Artificial Sequence
  Synthetic construct
ggtggctccatcagtagtagtacttactac

SEQ ID NO: 6018 - DNA, 30 bp, Artificial Sequence
  Synthetic construct
ggtggctccatcagcagtagtacttactac

SEQ ID NO: 6019 - DNA, 24 bp, Artificial Sequence
  Synthetic construct
ggtggctccatcactagttactac

SEQ ID NO: 6020 - DNA, 27 bp, Artificial Sequence
  Synthetic construct
ggtttctccatcagaaatggttatttc

SEQ ID NO: 6021 - DNA, 27 bp, Artificial Sequence
  Synthetic construct
ggttactccatcagtagtggttactac

SEQ ID NO: 6022 - DNA, 27 bp, Artificial Sequence
  Synthetic construct
ggttatttcatcagtagtggtcattat

SEQ ID NO: 6023 - DNA, 27 bp, Artificial Sequence
  Synthetic construct
ggttactccatgagcagaggttactac

SEQ ID NO: 6024 - DNA, 27 bp, Artificial Sequence
  Synthetic construct
aattactccattagcagtggctcttac

SEQ ID NO: 6025 - DNA, 27 bp, Artificial Sequence
  Synthetic construct
ggttactccatcagcagtggttactac

SEQ ID NO: 6026 - DNA, 27 bp, Artificial Sequence
  Synthetic construct
ggttattccatcagtactggttactac

SEQ ID NO: 6027 - DNA, 27 bp, Artificial Sequence
  Synthetic construct
ggttactccatcagcactggttactac

SEQ ID NO: 6028 - DNA, 27 bp, Artificial Sequence
  Synthetic construct
gtttactccatccgtagtgcttactac

SEQ ID NO: 6029 - DNA, 27 bp, Artificial Sequence
  Synthetic construct
ggttattccatcagcagtggttactac

SEQ ID NO: 6030 - DNA, 27 bp, Artificial Sequence
  Synthetic construct
ggtttcttcatttccactggttaccac

SEQ ID NO: 6031 - DNA, 27 bp, Artificial Sequence
  Synthetic construct
ggattctccatcaacagtgctcacctc

SEQ ID NO: 6032 - DNA, 30 bp, Artificial Sequence
  Synthetic construct
ggtggctccatcagcagtaatagttactat

SEQ ID NO: 6033 - DNA, 27 bp, Artificial Sequence
  Synthetic construct
ggtttctccatgagtgatagttactac

SEQ ID NO: 6034 - DNA, 27 bp, Artificial Sequence
  Synthetic construct
ggttactacatcaggactggttactac

SEQ ID NO: 6035 - DNA, 27 bp, Artificial Sequence
  Synthetic construct
ggtttctctctcatcggtggttaccac

SEQ ID NO: 6036 - DNA, 24 bp, Artificial Sequence
  Synthetic construct
ggaggcaccttcagcaggtatgct

SEQ ID NO: 6037 - DNA, 24 bp, Artificial Sequence
  Synthetic construct
ggaggcactttcatcaacaatgtt

SEQ ID NO: 6038 - DNA, 24 bp, Artificial Sequence
  Synthetic construct
gagggcaccctcaccaagtttgct

SEQ ID NO: 6039 - DNA, 24 bp, Artificial Sequence
  Synthetic construct
ggagcctccttcagcaatcatgct

SEQ ID NO: 6040 - DNA, 24 bp, Artificial Sequence
  Synthetic construct
gatggcgcctttagcacccatgct

SEQ ID NO: 6041 - DNA, 24 bp, Artificial Sequence
  Synthetic construct
ggactcatcttcagtgccgttggc

SEQ ID NO: 6042 - DNA, 24 bp, Artificial Sequence
  Synthetic construct
ggattcaccttcagtgactacacc

SEQ ID NO: 6043 - DNA, 24 bp, Artificial Sequence
  Synthetic construct
gggctcacctttagtacttctgaa

SEQ ID NO: 6044 - DNA, 24 bp, Artificial Sequence
  Synthetic construct
ggattcacgttcggcgaccactac

SEQ ID NO: 6045 - DNA, 24 bp, Artificial Sequence
  Synthetic construct
ggattcatctttgatgattttggc

SEQ ID NO: 6046 - DNA, 24 bp, Artificial Sequence
  Synthetic construct
ggattcagcatcagtgactactcg

SEQ ID NO: 6047 - DNA, 24 bp, Artificial Sequence
  Synthetic construct
ggattcacgttaaatacctatggc

SEQ ID NO: 6048 - DNA, 24 bp, Artificial Sequence
  Synthetic construct
ggatacaacttcctcggccactat

SEQ ID NO: 6049 - DNA, 24 bp, Artificial Sequence
  Synthetic construct
ggatacaccctcaccggaatatcc

SEQ ID NO: 6050 - DNA, 30 bp, Artificial Sequence
  Synthetic construct
gggttcccactgaccaccgaaaaagtgggt

SEQ ID NO: 6051 - DNA, 24 bp, Artificial Sequence
  Synthetic construct
ggaggcaccttcagcggctatggc

SEQ ID NO: 6052 - DNA, 24 bp, Artificial Sequence
  Synthetic construct
ggattcaccttcaggagctatggc

SEQ ID NO: 6053 - DNA, 21 bp, Artificial Sequence
  Synthetic construct
atcaatcatagtggaagcacc

SEQ ID NO: 6054 - DNA, 24 bp, Artificial Sequence
  Synthetic construct
agcatccctatgtatgaaacaaca

SEQ ID NO: 6055 - DNA, 21 bp, Artificial Sequence
  Synthetic construct
attcaaagcggtgggaccacc

SEQ ID NO: 6056 - DNA, 24 bp, Artificial Sequence
  Synthetic construct
atcagcggtcataatggtaacaca

SEQ ID NO: 6057 - DNA, 24 bp, Artificial Sequence
  Synthetic construct
atcaaccctactggtgctaccaca

SEQ ID NO: 6058 - DNA, 24 bp, Artificial Sequence
  Synthetic construct
atcatccctctgtttgattcacca

SEQ ID NO: 6059 - DNA, 30 bp, Artificial Sequence
  Synthetic construct
attcgaaccaagactttcaattacgcgaca

SEQ ID NO: 6060 - DNA, 24 bp, Artificial Sequence
  Synthetic construct
atatcatatgatggaaatgataaa

SEQ ID NO: 6061 - DNA, 24 bp, Artificial Sequence
  Synthetic construct
atatcgtatgatggaagcaatata

SEQ ID NO: 6062 - DNA, 30 bp, Artificial Sequence
  Synthetic construct
attagaagcagttctaacaaatatgcgaca

SEQ ID NO: 6063 - DNA, 30 bp, Artificial Sequence
  Synthetic construct
accagaagtaaggcaaacaatttcgcgaca

SEQ ID NO: 6064 - DNA, 30 bp, Artificial Sequence
  Synthetic construct
attaaaagcaaaagtaacaactatgcgaca

SEQ ID NO: 6065 - DNA, 24 bp, Artificial Sequence
  Synthetic construct
gttggtcctaaacctggtgaaaca

SEQ ID NO: 6066 - DNA, 24 bp, Artificial Sequence
  Synthetic construct
ttcaaccctagtgccgataccaaa

SEQ ID NO: 6067 - DNA, 24 bp, Artificial Sequence
  Synthetic construct
atcaaccctgacagtggtgacaca

SEQ ID NO: 6068 - DNA, 24 bp, Artificial Sequence
  Synthetic construct
atcaaccctaacagtggtgtcaca

SEQ ID NO: 6069 - DNA, 24 bp, Artificial Sequence
  Synthetic construct
atcaacaccgaccttgggacccca

SEQ ID NO: 6070 - DNA, 24 bp, Artificial Sequence
  Synthetic construct
atcaaccctagcactggtggctca

SEQ ID NO: 6071 - DNA, 24 bp, Artificial Sequence
  Synthetic construct
tacactcccaacggtggcagtaca

SEQ ID NO: 6072 - DNA, 24 bp, Artificial Sequence
  Synthetic construct
atcaacaagtataatggtgacaag

SEQ ID NO: 6073 - DNA, 24 bp, Artificial Sequence
  Synthetic construct
atcgaccctcacagtggtgccaca

SEQ ID NO: 6074 - DNA, 24 bp, Artificial Sequence
  Synthetic construct
atcaacgctggcaatggttacaca

SEQ ID NO: 6075 - DNA, 24 bp, Artificial Sequence
  Synthetic construct
atcaaccctggcaacggtaacaca

SEQ ID NO: 6076 - DNA, 24 bp, Artificial Sequence
  Synthetic construct
atcaacgctggcaatggtaacaca

SEQ ID NO: 6077 - DNA, 24 bp, Artificial Sequence
  Synthetic construct
atcaaccctaacagtggtagcaca

SEQ ID NO: 6078 - DNA, 24 bp, Artificial Sequence
  Synthetic construct
gtggatcctcaagatggtgaaaga

SEQ ID NO: 6079 - DNA, 24 bp, Artificial Sequence
  Synthetic construct
gttgatcctgaggatggtaaaacg

SEQ ID NO: 6080 - DNA, 24 bp, Artificial Sequence
  Synthetic construct
atcaacgctggcaatggtgacaca

SEQ ID NO: 6081 - DNA, 24 bp, Artificial Sequence
  Synthetic construct
gtgaaccctgacagtggtgccaca

SEQ ID NO: 6082 - DNA, 24 bp, Artificial Sequence
  Synthetic construct
atgaaccctaacagtggtaacaca

SEQ ID NO: 6083 - DNA, 24 bp, Artificial Sequence
  Synthetic construct
atgaaccctaatagtggtaacaca

SEQ ID NO: 6084 - DNA, 24 bp, Artificial Sequence
  Synthetic construct
atgaaccctaaaagtggtaacaca

SEQ ID NO: 6085 - DNA, 24 bp, Artificial Sequence
  Synthetic construct
atgaaccctaagagtggtgacaca

SEQ ID NO: 6086 - DNA, 24 bp, Artificial Sequence
  Synthetic construct
atcatccctatccttggcacatca

SEQ ID NO: 6087 - DNA, 24 bp, Artificial Sequence
  Synthetic construct
attgttccgatgtttggaacaact

SEQ ID NO: 6088 - DNA, 24 bp, Artificial Sequence
  Synthetic construct
atcagcgctgacaatggtaacaca

SEQ ID NO: 6089 - DNA, 24 bp, Artificial Sequence
  Synthetic construct
atcatccctatctttgctacagca

SEQ ID NO: 6090 - DNA, 24 bp, Artificial Sequence
  Synthetic construct
atgaaccctgccagtggtaacaca

SEQ ID NO: 6091 - DNA, 24 bp, Artificial Sequence
  Synthetic construct
atcaaccccaacagtggaaagcca

SEQ ID NO: 6092 - DNA, 18 bp, Artificial Sequence
  Synthetic construct
atcttctttcaaacaccc

SEQ ID NO: 6093 - DNA, 24 bp, Artificial Sequence
  Synthetic construct
atcatccccagctttggaacagcg

SEQ ID NO: 6094 - DNA, 24 bp, Artificial Sequence
  Synthetic construct
atcatccctatctttggtacagca

SEQ ID NO: 6095 - DNA, 24 bp, Artificial Sequence
  Synthetic construct
atcagcgcttccactgcgaacaca

SEQ ID NO: 6096 - DNA, 24 bp, Artificial Sequence
  Synthetic construct
atcagcggtaataatgataacaca

SEQ ID NO: 6097 - DNA, 24 bp, Artificial Sequence
  Synthetic construct
atcatccctttccttgctagagca

SEQ ID NO: 6098 - DNA, 24 bp, Artificial Sequence
  Synthetic construct
atccgcgctgacattggtgacaca

SEQ ID NO: 6099 - DNA, 24 bp, Artificial Sequence
  Synthetic construct
atcagcctttacaatggtgccaca

SEQ ID NO: 6100 - DNA, 24 bp, Artificial Sequence
  Synthetic construct
ttcatccccatttttggcacaacg

SEQ ID NO: 6101 - DNA, 24 bp, Artificial Sequence
  Synthetic construct
gtgctgccactgttcggagtcacc

SEQ ID NO: 6102 - DNA, 24 bp, Artificial Sequence
  Synthetic construct
gtcatccctatgtttggtgcaaca

SEQ ID NO: 6103 - DNA, 24 bp, Artificial Sequence
  Synthetic construct
atcaactcttacaatggtaacaca

SEQ ID NO: 6104 - DNA, 24 bp, Artificial Sequence
  Synthetic construct
ctcacccctatttttggaactgct

SEQ ID NO: 6105 - DNA, 24 bp, Artificial Sequence
  Synthetic construct
atcatccctctctttggtacaaca

SEQ ID NO: 6106 - DNA, 24 bp, Artificial Sequence
  Synthetic construct
atcatccctctctttggttcagga

SEQ ID NO: 6107 - DNA, 24 bp, Artificial Sequence
  Synthetic construct
atcatccctatctttggtacaaca

SEQ ID NO: 6108 - DNA, 24 bp, Artificial Sequence
  Synthetic construct
atcatcgctgtctttggtacacca

SEQ ID NO: 6109 - DNA, 24 bp, Artificial Sequence
  Synthetic construct
atcatccctatgtctggtacagcc

SEQ ID NO: 6110 - DNA, 24 bp, Artificial Sequence
  Synthetic construct
atcagcgcttacaatggtgacaca

SEQ ID NO: 6111 - DNA, 21 bp, Artificial Sequence
  Synthetic construct
atcagctacaatggtaatata

SEQ ID NO: 6112 - DNA, 24 bp, Artificial Sequence
  Synthetic construct
atcagcgcttacaatggtaacaca

SEQ ID NO: 6113 - DNA, 24 bp, Artificial Sequence
  Synthetic construct
atcaacacttactatggtcacaca

SEQ ID NO: 6114 - DNA, 24 bp, Artificial Sequence
  Synthetic construct
atcatccctctctttggtgcacca

SEQ ID NO: 6115 - DNA, 24 bp, Artificial Sequence
  Synthetic construct
atcatctgtatctctgaagcacca

SEQ ID NO: 6116 - DNA, 24 bp, Artificial Sequence
  Synthetic construct
atcatccctatctttgctacaaca

SEQ ID NO: 6117 - DNA, 24 bp, Artificial Sequence
  Synthetic construct
attagcggtgacaatggcaacaca

SEQ ID NO: 6118 - DNA, 24 bp, Artificial Sequence
  Synthetic construct
atcatcccgatctttggtacggtg

SEQ ID NO: 6119 - DNA, 24 bp, Artificial Sequence
  Synthetic construct
atcatccctatccatggtacagtg

SEQ ID NO: 6120 - DNA, 24 bp, Artificial Sequence
  Synthetic construct
ataagcgcttacgacgggcgcaca

SEQ ID NO: 6121 - DNA, 24 bp, Artificial Sequence
  Synthetic construct
atcatccccatctttggaacaaca

SEQ ID NO: 6122 - DNA, 24 bp, Artificial Sequence
  Synthetic construct
atccgcccttacaatggtcagaca

SEQ ID NO: 6123 - DNA, 24 bp, Artificial Sequence
  Synthetic construct
ataaccacttacaatggtaacaca

SEQ ID NO: 6124 - DNA, 24 bp, Artificial Sequence
  Synthetic construct
atcatccctatctttggtactcca

SEQ ID NO: 6125 - DNA, 24 bp, Artificial Sequence
  Synthetic construct
atgaacaccaacactgggcagcca

SEQ ID NO: 6126 - DNA, 24 bp, Artificial Sequence
  Synthetic construct
attgatcccgagaatggtgaaaca

SEQ ID NO: 6127 - DNA, 24 bp, Artificial Sequence
  Synthetic construct
atttcatttggtgggagtgatcaa

SEQ ID NO: 6128 - DNA, 24 bp, Artificial Sequence
  Synthetic construct
attgatcctgaagatggagaaaca

SEQ ID NO: 6129 - DNA, 24 bp, Artificial Sequence
  Synthetic construct
atcatcccaagttttggagcagca

SEQ ID NO: 6130 - DNA, 24 bp, Artificial Sequence
  Synthetic construct
atcaaccccactggtagaagcaca

SEQ ID NO: 6131 - DNA, 24 bp, Artificial Sequence
  Synthetic construct
atcaaccctaacagtggtgacaca

SEQ ID NO: 6132 - DNA, 24 bp, Artificial Sequence
  Synthetic construct
atcaaccctaacgatggagacaca

SEQ ID NO: 6133 - DNA, 24 bp, Artificial Sequence
  Synthetic construct
ttggatcctgacgacggtgaaaca

SEQ ID NO: 6134 - DNA, 24 bp, Artificial Sequence
  Synthetic construct
tttgatccagaagatggtgaaaca

SEQ ID NO: 6135 - DNA, 24 bp, Artificial Sequence
  Synthetic construct
atgaacccaaccagtggtgacaca

SEQ ID NO: 6136 - DNA, 24 bp, Artificial Sequence
  Synthetic construct
atcaaccctactagtgatagcaca

SEQ ID NO: 6137 - DNA, 24 bp, Artificial Sequence
  Synthetic construct
gtcagccctatttctggaagaggt

SEQ ID NO: 6138 - DNA, 24 bp, Artificial Sequence
  Synthetic construct
atcaacgctgccagtggtgacacc

SEQ ID NO: 6139 - DNA, 24 bp, Artificial Sequence
  Synthetic construct
atctatcctggtgactctgatacc

SEQ ID NO: 6140 - DNA, 24 bp, Artificial Sequence
  Synthetic construct
atctatcctaatgattttgatacc

SEQ ID NO: 6141 - DNA, 24 bp, Artificial Sequence
  Synthetic construct
atctatcctggtgactctgacacc

SEQ ID NO: 6142 - DNA, 24 bp, Artificial Sequence
  Synthetic construct
atcaatcctgaagactctgatatt

SEQ ID NO: 6143 - DNA, 24 bp, Artificial Sequence
  Synthetic construct
atctttcctgaggactctgatacc

SEQ ID NO: 6144 - DNA, 24 bp, Artificial Sequence
  Synthetic construct
ataaatcctgctgactcgggtgtc

SEQ ID NO: 6145 - DNA, 24 bp, Artificial Sequence
  Synthetic construct
atctatcctggtgactctgataca

SEQ ID NO: 6146 - DNA, 24 bp, Artificial Sequence
  Synthetic construct
atgtttcctgatgactctgatacc

SEQ ID NO: 6147 - DNA, 24 bp, Artificial Sequence
  Synthetic construct
atctatcctgatgactctgatacc

SEQ ID NO: 6148 - DNA, 24 bp, Artificial Sequence
  Synthetic construct
atttatcctggtgactctcatgtc

SEQ ID NO: 6149 - DNA, 24 bp, Artificial Sequence
  Synthetic construct
ctctatcctggtgactcagatatt

SEQ ID NO: 6150 - DNA, 24 bp, Artificial Sequence
  Synthetic construct
atcaatcctggtgactctgaaact

SEQ ID NO: 6151 - DNA, 24 bp, Artificial Sequence
  Synthetic construct
atctatcctgatgacgctgataca

SEQ ID NO: 6152 - DNA, 24 bp, Artificial Sequence
  Synthetic construct
atctatcctggtgattctgatacc

SEQ ID NO: 6153 - DNA, 24 bp, Artificial Sequence
  Synthetic construct
atctatcctggtgactctgatagt

SEQ ID NO: 6154 - DNA, 24 bp, Artificial Sequence
  Synthetic construct
atctaccctggtgactctgatacc

SEQ ID NO: 6155 - DNA, 24 bp, Artificial Sequence
  Synthetic construct
atctttcctggtgactctgatagc

SEQ ID NO: 6156 - DNA, 24 bp, Artificial Sequence
  Synthetic construct
atcaacacctaccaaggcaataca

SEQ ID NO: 6157 - DNA, 24 bp, Artificial Sequence
  Synthetic construct
atcatccctgtgtttgggacacca

SEQ ID NO: 6158 - DNA, 24 bp, Artificial Sequence
  Synthetic construct
atcagtaatagtggtgatactata

SEQ ID NO: 6159 - DNA, 24 bp, Artificial Sequence
  Synthetic construct
gttaatgttggtggtggaatcaca

SEQ ID NO: 6160 - DNA, 24 bp, Artificial Sequence
  Synthetic construct
attagtggtagtggtagtaccaaa

SEQ ID NO: 6161 - DNA, 30 bp, Artificial Sequence
  Synthetic construct
gtgaaaagcaaaactgatggtgggacaaca

SEQ ID NO: 6162 - DNA, 24 bp, Artificial Sequence
  Synthetic construct
attaataacattggtgacaacata

SEQ ID NO: 6163 - DNA, 24 bp, Artificial Sequence
  Synthetic construct
attagtagtagtagtaatttcata

SEQ ID NO: 6164 - DNA, 21 bp, Artificial Sequence
  Synthetic construct
attactagtggtggttacaca

SEQ ID NO: 6165 - DNA, 24 bp, Artificial Sequence
  Synthetic construct
attagtagaagtggtagtaccata

SEQ ID NO: 6166 - DNA, 24 bp, Artificial Sequence
  Synthetic construct
attagtagtgatgctgataacaca

SEQ ID NO: 6167 - DNA, 21 bp, Artificial Sequence
  Synthetic construct
attagtggtggtggaattact

SEQ ID NO: 6168 - DNA, 24 bp, Artificial Sequence
  Synthetic construct
atgattggtactggtggtaccaca

SEQ ID NO: 6169 - DNA, 24 bp, Artificial Sequence
  Synthetic construct
attagtagcagtggtagtattgta

SEQ ID NO: 6170 - DNA, 24 bp, Artificial Sequence
  Synthetic construct
atcagtactagtggttcttactta

SEQ ID NO: 6171 - DNA, 24 bp, Artificial Sequence
  Synthetic construct
attagtagtagtggtagtcacatt

SEQ ID NO: 6172 - DNA, 24 bp, Artificial Sequence
  Synthetic construct
attagtagtaccagtcgttacata

SEQ ID NO: 6173 - DNA, 24 bp, Artificial Sequence
  Synthetic construct
attagtagtggtagtaattacata

SEQ ID NO: 6174 - DNA, 24 bp, Artificial Sequence
  Synthetic construct
attagtggtagtagtaatgacata

SEQ ID NO: 6175 - DNA, 24 bp, Artificial Sequence
  Synthetic construct
attaggagtagtagtacttacata

SEQ ID NO: 6176 - DNA, 24 bp, Artificial Sequence
  Synthetic construct
ataagtggtagtagtagttacaga

SEQ ID NO: 6177 - DNA, 24 bp, Artificial Sequence
  Synthetic construct
attagtagtagtagtagttacata

SEQ ID NO: 6178 - DNA, 24 bp, Artificial Sequence
  Synthetic construct
attagtactagtagtagttacaca

SEQ ID NO: 6179 - DNA, 24 bp, Artificial Sequence
  Synthetic construct
attagcattattggtagtaccata

SEQ ID NO: 6180 - DNA, 24 bp, Artificial Sequence
  Synthetic construct
attagtagtagtggtagtaccatg

SEQ ID NO: 6181 - DNA, 24 bp, Artificial Sequence
  Synthetic construct
attgatagtggtggtactaccata

SEQ ID NO: 6182 - DNA, 24 bp, Artificial Sequence
  Synthetic construct
attagtagtagtggtggaaccata

SEQ ID NO: 6183 - DNA, 24 bp, Artificial Sequence
  Synthetic construct
attagtagtactggtagtaccata

SEQ ID NO: 6184 - DNA, 24 bp, Artificial Sequence
  Synthetic construct
attagtagtggtggttataccata

SEQ ID NO: 6185 - DNA, 24 bp, Artificial Sequence
  Synthetic construct
attagtagtagtgctaatgacatt

SEQ ID NO: 6186 - DNA, 24 bp, Artificial Sequence
  Synthetic construct
attagtagtagtggtagtaccata

SEQ ID NO: 6187 - DNA, 24 bp, Artificial Sequence
  Synthetic construct
attagtagtagtggaagtaccata

SEQ ID NO: 6188 - DNA, 24 bp, Artificial Sequence
  Synthetic construct
atcagcagtattagcaattacatt

SEQ ID NO: 6189 - DNA, 24 bp, Artificial Sequence
  Synthetic construct
atcagtagtggggggagtaccaca

SEQ ID NO: 6190 - DNA, 24 bp, Artificial Sequence
  Synthetic construct
attagtagtagtggtagtaccatt

SEQ ID NO: 6191 - DNA, 24 bp, Artificial Sequence
  Synthetic construct
attagtagtactagttttcccatc

SEQ ID NO: 6192 - DNA, 24 bp, Artificial Sequence
  Synthetic construct
attggaagtagtagtagtgtcata

SEQ ID NO: 6193 - DNA, 24 bp, Artificial Sequence
  Synthetic construct
attagtgatagtgggaggaccata

SEQ ID NO: 6194 - DNA, 24 bp, Artificial Sequence
  Synthetic construct
attagtagcagtgatagttacata

SEQ ID NO: 6195 - DNA, 24 bp, Artificial Sequence
  Synthetic construct
attagttttcgtagtcatttcata

SEQ ID NO: 6196 - DNA, 24 bp, Artificial Sequence
  Synthetic construct
attaatagttatagcagtcacata

SEQ ID NO: 6197 - DNA, 24 bp, Artificial Sequence
  Synthetic construct
atcatccctatctttggaacagca

SEQ ID NO: 6198 - DNA, 24 bp, Artificial Sequence
  Synthetic construct
attagtggcagtggggataccatc

SEQ ID NO: 6199 - DNA, 24 bp, Artificial Sequence
  Synthetic construct
attagtcctactggtagtaccgga

SEQ ID NO: 6200 - DNA, 24 bp, Artificial Sequence
  Synthetic construct
attactagtgatgggaattacata

SEQ ID NO: 6201 - DNA, 24 bp, Artificial Sequence
  Synthetic construct
atcagtggcagtggaacgacgata

SEQ ID NO: 6202 - DNA, 24 bp, Artificial Sequence
  Synthetic construct
attagtcgtactgggactatcata

SEQ ID NO: 6203 - DNA, 24 bp, Artificial Sequence
  Synthetic construct
attggttctagtggaagtaccata

SEQ ID NO: 6204 - DNA, 24 bp, Artificial Sequence
  Synthetic construct
attagtggtaatggtgacaccatc

SEQ ID NO: 6205 - DNA, 30 bp, Artificial Sequence
  Synthetic construct
attaaaagcgaaactgatggtgggacaaca

SEQ ID NO: 6206 - DNA, 24 bp, Artificial Sequence
  Synthetic construct
atcagtagttctgggagtatgata

SEQ ID NO: 6207 - DNA, 24 bp, Artificial Sequence
  Synthetic construct
ataactcgccgtgggacttacatc

SEQ ID NO: 6208 - DNA, 24 bp, Artificial Sequence
  Synthetic construct
atcaacaccaacactgggaaccca

SEQ ID NO: 6209 - DNA, 24 bp, Artificial Sequence
  Synthetic construct
atcaacaccaaaactgggaacccg

SEQ ID NO: 6210 - DNA, 24 bp, Artificial Sequence
  Synthetic construct
atcaacaccaacactgggaggcca

SEQ ID NO: 6211 - DNA, 24 bp, Artificial Sequence
  Synthetic construct
atcaacaccaaaactgggaacgca

SEQ ID NO: 6212 - DNA, 24 bp, Artificial Sequence
  Synthetic construct
ataaattttagtggtggtgtcacc

SEQ ID NO: 6213 - DNA, 24 bp, Artificial Sequence
  Synthetic construct
atcgattggaatggagagaattcg

SEQ ID NO: 6214 - DNA, 24 bp, Artificial Sequence
  Synthetic construct
ataactgatagtggtgcgagcaca

SEQ ID NO: 6215 - DNA, 24 bp, Artificial Sequence
  Synthetic construct
attagtggtagtggtggtaataca

SEQ ID NO: 6216 - DNA, 30 bp, Artificial Sequence
  Synthetic construct
attagaagcaaagctaccggtgggacagca

SEQ ID NO: 6217 - DNA, 24 bp, Artificial Sequence
  Synthetic construct
attagtgaaagtggtggtagcaca

SEQ ID NO: 6218 - DNA, 24 bp, Artificial Sequence
  Synthetic construct
attagtggtagtggttctagcaca

SEQ ID NO: 6219 - DNA, 24 bp, Artificial Sequence
  Synthetic construct
ataaaccaggatggaactgagaca

SEQ ID NO: 6220 - DNA, 24 bp, Artificial Sequence
  Synthetic construct
attattaatagtggtgggagcaca

SEQ ID NO: 6221 - DNA, 24 bp, Artificial Sequence
  Synthetic construct
attagtcgcagtggtgatgcaaca

SEQ ID NO: 6222 - DNA, 24 bp, Artificial Sequence
  Synthetic construct
attagcgggagcgctggtaggaca

SEQ ID NO: 6223 - DNA, 24 bp, Artificial Sequence
  Synthetic construct
ataaagcaagatggaagtgagaaa

SEQ ID NO: 6224 - DNA, 24 bp, Artificial Sequence
  Synthetic construct
ataaagtcagatggaagtgagaaa

SEQ ID NO: 6225 - DNA, 24 bp, Artificial Sequence
  Synthetic construct
attgctagtagtggtagaaccata

SEQ ID NO: 6226 - DNA, 30 bp, Artificial Sequence
  Synthetic construct
attaaaggcaaagattttggcgggaaaaca

SEQ ID NO: 6227 - DNA, 24 bp, Artificial Sequence
  Synthetic construct
attagtgggagtggttccaggata

SEQ ID NO: 6228 - DNA, 24 bp, Artificial Sequence
  Synthetic construct
ataaacctagacggaagtttccaa

SEQ ID NO: 6229 - DNA, 30 bp, Artificial Sequence
  Synthetic construct
attaaaagcagagcttatagtgggacgaca

SEQ ID NO: 6230 - DNA, 24 bp, Artificial Sequence
  Synthetic construct
ataaaacaggattcaggcgcgaga

SEQ ID NO: 6231 - DNA, 24 bp, Artificial Sequence
  Synthetic construct
attgatagtggtgttaggccccta

SEQ ID NO: 6232 - DNA, 24 bp, Artificial Sequence
  Synthetic construct
attagtcaaagtggcagcaggaaa

SEQ ID NO: 6233 - DNA, 24 bp, Artificial Sequence
  Synthetic construct
gttgacgaaactgccactggcaca

SEQ ID NO: 6234 - DNA, 24 bp, Artificial Sequence
  Synthetic construct
attagtgctagtggtggaaacaca

SEQ ID NO: 6235 - DNA, 24 bp, Artificial Sequence
  Synthetic construct
attagtagtagtggtaataccata

SEQ ID NO: 6236 - DNA, 24 bp, Artificial Sequence
  Synthetic construct
attagtagcagtggtagtaccaag

SEQ ID NO: 6237 - DNA, 24 bp, Artificial Sequence
  Synthetic construct
attagtagtagtggcaacaccaaa

SEQ ID NO: 6238 - DNA, 24 bp, Artificial Sequence
  Synthetic construct
attagtagtagtggaagtaccaca

SEQ ID NO: 6239 - DNA, 24 bp, Artificial Sequence
  Synthetic construct
attaattggtatggagaaaggaca

SEQ ID NO: 6240 - DNA, 24 bp, Artificial Sequence
  Synthetic construct
attactggaagtggtgataacatg

SEQ ID NO: 6241 - DNA, 24 bp, Artificial Sequence
  Synthetic construct
cttaccggtggtggtgctatcaca

SEQ ID NO: 6242 - DNA, 24 bp, Artificial Sequence
  Synthetic construct
attagtggtaatggtggtagcaca

SEQ ID NO: 6243 - DNA, 21 bp, Artificial Sequence
  Synthetic construct
ctttatggcgttagaagcaca

SEQ ID NO: 6244 - DNA, 30 bp, Artificial Sequence
  Synthetic construct
attaaaagcaaccttcttggtgcgacagca

SEQ ID NO: 6245 - DNA, 30 bp, Artificial Sequence
  Synthetic construct
attagaagtaaagcttatggtgagacaaca

SEQ ID NO: 6246 - DNA, 30 bp, Artificial Sequence
  Synthetic construct
attagaagcaaagcttatggtgggacaaca

SEQ ID NO: 6247 - DNA, 21 bp, Artificial Sequence
  Synthetic construct
atgtatcctggtggtttcgca

SEQ ID NO: 6248 - DNA, 21 bp, Artificial Sequence
  Synthetic construct
atttatagtggtggtagtaca

SEQ ID NO: 6249 - DNA, 24 bp, Artificial Sequence
  Synthetic construct
attggtggtagtggtgcttacaaa

SEQ ID NO: 6250 - DNA, 24 bp, Artificial Sequence
  Synthetic construct
actagtggtagtggtggaagaaca

SEQ ID NO: 6251 - DNA, 24 bp, Artificial Sequence
  Synthetic construct
attagtggaagtggtgatagtaca

SEQ ID NO: 6252 - DNA, 24 bp, Artificial Sequence
  Synthetic construct
attggtggtagtggtggtcccaca

SEQ ID NO: 6253 - DNA, 24 bp, Artificial Sequence
  Synthetic construct
attagtggtagtggtggtagcaca

SEQ ID NO: 6254 - DNA, 24 bp, Artificial Sequence
  Synthetic construct
attagtgctagtggtactataaca

SEQ ID NO: 6255 - DNA, 24 bp, Artificial Sequence
  Synthetic construct
attagtggtggtggtcgtcacaca

SEQ ID NO: 6256 - DNA, 24 bp, Artificial Sequence
  Synthetic construct
atcagtggcagtggtggtaccaca

SEQ ID NO: 6257 - DNA, 24 bp, Artificial Sequence
  Synthetic construct
attggtgggagtggtggttctaca

SEQ ID NO: 6258 - DNA, 21 bp, Artificial Sequence
  Synthetic construct
atttatagcggtggtagcaca

SEQ ID NO: 6259 - DNA, 24 bp, Artificial Sequence
  Synthetic construct
attagtactggtagtactaagatt

SEQ ID NO: 6260 - DNA, 24 bp, Artificial Sequence
  Synthetic construct
ataaagcaagacggaagtgagaaa

SEQ ID NO: 6261 - DNA, 24 bp, Artificial Sequence
  Synthetic construct
ataaagcaagatggcagtgagaaa

SEQ ID NO: 6262 - DNA, 24 bp, Artificial Sequence
  Synthetic construct
ataaagaaagatggaagtgagaaa

SEQ ID NO: 6263 - DNA, 24 bp, Artificial Sequence
  Synthetic construct
ataagcgacgacggatttcaaaaa

SEQ ID NO: 6264 - DNA, 30 bp, Artificial Sequence
  Synthetic construct
attaaaagcaaaactgatggtgggacaaca

SEQ ID NO: 6265 - DNA, 30 bp, Artificial Sequence
  Synthetic construct
attacaaccaattctgatggtgggacaaca

SEQ ID NO: 6266 - DNA, 30 bp, Artificial Sequence
  Synthetic construct
attaaaagcaaaactgatgatgggacaaca

SEQ ID NO: 6267 - DNA, 30 bp, Artificial Sequence
  Synthetic construct
attagaagcaaagcttttggtgggaccaca

SEQ ID NO: 6268 - DNA, 24 bp, Artificial Sequence
  Synthetic construct
attagtggtagtggtgatagcaca

SEQ ID NO: 6269 - DNA, 24 bp, Artificial Sequence
  Synthetic construct
ataaagcaagatgggagtgacaaa

SEQ ID NO: 6270 - DNA, 24 bp, Artificial Sequence
  Synthetic construct
ataaaccaagatggaagtgagcga

SEQ ID NO: 6271 - DNA, 21 bp, Artificial Sequence
  Synthetic construct
atctatatcggtgatagagca

SEQ ID NO: 6272 - DNA, 24 bp, Artificial Sequence
  Synthetic construct
atcaagttcgatggaagtgaaaaa

SEQ ID NO: 6273 - DNA, 24 bp, Artificial Sequence
  Synthetic construct
gttagtagtggtggcagtacaaaa

SEQ ID NO: 6274 - DNA, 24 bp, Artificial Sequence
  Synthetic construct
attaatggcgatggcacaagtgca

SEQ ID NO: 6275 - DNA, 24 bp, Artificial Sequence
  Synthetic construct
ataaaatatgatggcagtgagaaa

SEQ ID NO: 6276 - DNA, 24 bp, Artificial Sequence
  Synthetic construct
atcactactcaaggctctaccata

SEQ ID NO: 6277 - DNA, 21 bp, Artificial Sequence
  Synthetic construct
attagtggtagtggtgcccca

SEQ ID NO: 6278 - DNA, 24 bp, Artificial Sequence
  Synthetic construct
gttagtgctagtggtggtaacaca

SEQ ID NO: 6279 - DNA, 30 bp, Artificial Sequence
  Synthetic construct
attaaaagcaacactgatggtgagacaaca

SEQ ID NO: 6280 - DNA, 24 bp, Artificial Sequence
  Synthetic construct
ataagatttgatgcgactgacacg

SEQ ID NO: 6281 - DNA, 24 bp, Artificial Sequence
  Synthetic construct
ataaaaaaagatggaagtgagaaa

SEQ ID NO: 6282 - DNA, 30 bp, Artificial Sequence
  Synthetic construct
attaagacgaaggaagatggtgggacaaca

SEQ ID NO: 6283 - DNA, 24 bp, Artificial Sequence
  Synthetic construct
attagcgccagcggcggtaccaca

SEQ ID NO: 6284 - DNA, 24 bp, Artificial Sequence
  Synthetic construct
accatccccatttctggcacagca

SEQ ID NO: 6285 - DNA, 24 bp, Artificial Sequence
  Synthetic construct
attagtagcagtggtagtggcata

SEQ ID NO: 6286 - DNA, 24 bp, Artificial Sequence
  Synthetic construct
atcagtagtggtggtggtaggaca

SEQ ID NO: 6287 - DNA, 24 bp, Artificial Sequence
  Synthetic construct
gtttctactaggggtgataccaca

SEQ ID NO: 6288 - DNA, 24 bp, Artificial Sequence
  Synthetic construct
gtggatcctgaagatggcaaaact

SEQ ID NO: 6289 - DNA, 24 bp, Artificial Sequence
  Synthetic construct
atttcacacgatggaaatagtaaa

SEQ ID NO: 6290 - DNA, 24 bp, Artificial Sequence
  Synthetic construct
attaatagtgatggaaataataca

SEQ ID NO: 6291 - DNA, 24 bp, Artificial Sequence
  Synthetic construct
attagtagtggtgatgtcttcatc

SEQ ID NO: 6292 - DNA, 24 bp, Artificial Sequence
  Synthetic construct
attactaattctggggctggcaca

SEQ ID NO: 6293 - DNA, 24 bp, Artificial Sequence
  Synthetic construct
gtctcatatgatggagacaataaa

SEQ ID NO: 6294 - DNA, 24 bp, Artificial Sequence
  Synthetic construct
atctcttatgatggaattaataaa

SEQ ID NO: 6295 - DNA, 24 bp, Artificial Sequence
  Synthetic construct
gtgtcatttgatggaaacaaaaaa

SEQ ID NO: 6296 - DNA, 24 bp, Artificial Sequence
  Synthetic construct
atatcatataatggaagcagacaa

SEQ ID NO: 6297 - DNA, 24 bp, Artificial Sequence
  Synthetic construct
atatcaaatgatggaaccaaaaca

SEQ ID NO: 6298 - DNA, 24 bp, Artificial Sequence
  Synthetic construct
atatcaaatgacagaaataagaac

SEQ ID NO: 6299 - DNA, 24 bp, Artificial Sequence
  Synthetic construct
atatcatatgatggaacctataaa

SEQ ID NO: 6300 - DNA, 24 bp, Artificial Sequence
  Synthetic construct
ctttggtatgatggaagtaataaa

SEQ ID NO: 6301 - DNA, 24 bp, Artificial Sequence
  Synthetic construct
atatcatttgatggaaacactgag

SEQ ID NO: 6302 - DNA, 24 bp, Artificial Sequence
  Synthetic construct
atctcatatgatgcaagtactgaa

SEQ ID NO: 6303 - DNA, 24 bp, Artificial Sequence
  Synthetic construct
atatcatatgatggaagtaataaa

SEQ ID NO: 6304 - DNA, 24 bp, Artificial Sequence
  Synthetic construct
atatcaaatgatgacagcatcaaa

SEQ ID NO: 6305 - DNA, 24 bp, Artificial Sequence
  Synthetic construct
atatcctatgatgggggcaataaa

SEQ ID NO: 6306 - DNA, 24 bp, Artificial Sequence
  Synthetic construct
atttcaaatgatggaagtaatgaa

SEQ ID NO: 6307 - DNA, 24 bp, Artificial Sequence
  Synthetic construct
atatggtatgatggcactaagaaa

SEQ ID NO: 6308 - DNA, 24 bp, Artificial Sequence
  Synthetic construct
atatcatatgatggaagcaataaa

SEQ ID NO: 6309 - DNA, 24 bp, Artificial Sequence
  Synthetic construct
acatcagatgatggaagcagtaaa

SEQ ID NO: 6310 - DNA, 24 bp, Artificial Sequence
  Synthetic construct
atatggtatgatggaagtaatgaa

SEQ ID NO: 6311 - DNA, 24 bp, Artificial Sequence
  Synthetic construct
atatggtatgatggaagtaataaa

SEQ ID NO: 6312 - DNA, 24 bp, Artificial Sequence
  Synthetic construct
atatggaatgacggacagaagtca

SEQ ID NO: 6313 - DNA, 24 bp, Artificial Sequence
  Synthetic construct
atatcaaatgatggaagcaataaa

SEQ ID NO: 6314 - DNA, 24 bp, Artificial Sequence
  Synthetic construct
atatggtatgatggaagtaatcaa

SEQ ID NO: 6315 - DNA, 24 bp, Artificial Sequence
  Synthetic construct
atatcacatgatggaaacaagaaa

SEQ ID NO: 6316 - DNA, 24 bp, Artificial Sequence
  Synthetic construct
gtatcacttgatggagacaaagaa

SEQ ID NO: 6317 - DNA, 24 bp, Artificial Sequence
  Synthetic construct
atatcatatgatggaaacaatgaa

SEQ ID NO: 6318 - DNA, 24 bp, Artificial Sequence
  Synthetic construct
atatcagatgatggacaccataaa

SEQ ID NO: 6319 - DNA, 24 bp, Artificial Sequence
  Synthetic construct
atatcatatgatggaagccatgat

SEQ ID NO: 6320 - DNA, 24 bp, Artificial Sequence
  Synthetic construct
gtgtcatatgacgagagacagaaa

SEQ ID NO: 6321 - DNA, 24 bp, Artificial Sequence
  Synthetic construct
atctcatatcatggaagtgataaa

SEQ ID NO: 6322 - DNA, 30 bp, Artificial Sequence
  Synthetic construct
attagaagcaaagctaacagttacgcgaca

SEQ ID NO: 6323 - DNA, 24 bp, Artificial Sequence
  Synthetic construct
attagttggaatagtgttaccata

SEQ ID NO: 6324 - DNA, 24 bp, Artificial Sequence
  Synthetic construct
attacttggaatagtggtagcaca

SEQ ID NO: 6325 - DNA, 24 bp, Artificial Sequence
  Synthetic construct
attagttggaatagtggtagcgta

SEQ ID NO: 6326 - DNA, 24 bp, Artificial Sequence
  Synthetic construct
attagttggaatagtagaagcata

SEQ ID NO: 6327 - DNA, 24 bp, Artificial Sequence
  Synthetic construct
attagttggaatagtggtagcata

SEQ ID NO: 6328 - DNA, 24 bp, Artificial Sequence
  Synthetic construct
attaattgggatggtagtatcacg

SEQ ID NO: 6329 - DNA, 24 bp, Artificial Sequence
  Synthetic construct
attaattgggatggtagtagtaca

SEQ ID NO: 6330 - DNA, 24 bp, Artificial Sequence
  Synthetic construct
attacttgggatggtggtcacaca

SEQ ID NO: 6331 - DNA, 24 bp, Artificial Sequence
  Synthetic construct
gttgatcctgaagatggtgaaaca

SEQ ID NO: 6332 - DNA, 24 bp, Artificial Sequence
  Synthetic construct
gttgatccagaagatggtgaaaca

SEQ ID NO: 6333 - DNA, 24 bp, Artificial Sequence
  Synthetic construct
gttgatcctgaaaataatgaagcg

SEQ ID NO: 6334 - DNA, 24 bp, Artificial Sequence
  Synthetic construct
atcaaccctagtggtggtagcaca

SEQ ID NO: 6335 - DNA, 24 bp, Artificial Sequence
  Synthetic construct
atcagaccttctggtggtagcaca

SEQ ID NO: 6336 - DNA, 24 bp, Artificial Sequence
  Synthetic construct
atcaaccctagtggtggtacccca

SEQ ID NO: 6337 - DNA, 24 bp, Artificial Sequence
  Synthetic construct
atcaaccctaatagtggtagctca

SEQ ID NO: 6338 - DNA, 24 bp, Artificial Sequence
  Synthetic construct
atcaaccctaacagtggtggcaca

SEQ ID NO: 6339 - DNA, 24 bp, Artificial Sequence
  Synthetic construct
atcaaccctaacagtggtggcacc

SEQ ID NO: 6340 - DNA, 24 bp, Artificial Sequence
  Synthetic construct
atcaaccctagtggtggtaacaca

SEQ ID NO: 6341 - DNA, 24 bp, Artificial Sequence
  Synthetic construct
atcaatcccaatgatggaaacaca

SEQ ID NO: 6342 - DNA, 24 bp, Artificial Sequence
  Synthetic construct
tttgatcctgaagatggtgaaaca

SEQ ID NO: 6343 - DNA, 24 bp, Artificial Sequence
  Synthetic construct
atcaacggtgacaatggtaacaca

SEQ ID NO: 6344 - DNA, 24 bp, Artificial Sequence
  Synthetic construct
atcgtcgttggcagtggtaacaca

SEQ ID NO: 6345 - DNA, 24 bp, Artificial Sequence
  Synthetic construct
atatcatatgatgggaggcaagaa

SEQ ID NO: 6346 - DNA, 24 bp, Artificial Sequence
  Synthetic construct
atcaacgctggcaatgataacaca

SEQ ID NO: 6347 - DNA, 24 bp, Artificial Sequence
  Synthetic construct
atcaacactggcaagggctataca

SEQ ID NO: 6348 - DNA, 24 bp, Artificial Sequence
  Synthetic construct
attaatcctgaaaatgatgaaacc

SEQ ID NO: 6349 - DNA, 24 bp, Artificial Sequence
  Synthetic construct
attagttatagtagtaattacata

SEQ ID NO: 6350 - DNA, 30 bp, Artificial Sequence
  Synthetic construct
gctggagacaaaattcacaattatatcata

SEQ ID NO: 6351 - DNA, 30 bp, Artificial Sequence
  Synthetic construct
attagagataagtctcacggcgcgacaacg

SEQ ID NO: 6352 - DNA, 21 bp, Artificial Sequence
  Synthetic construct
atttatatcggtggaagcaca

SEQ ID NO: 6353 - DNA, 24 bp, Artificial Sequence
  Synthetic construct
attagtcacagtagtagttatgta

SEQ ID NO: 6354 - DNA, 24 bp, Artificial Sequence
  Synthetic construct
gtcagtagtagtggacaaaccact

SEQ ID NO: 6355 - DNA, 24 bp, Artificial Sequence
  Synthetic construct
attagtagtagtggtgatgacatg

SEQ ID NO: 6356 - DNA, 24 bp, Artificial Sequence
  Synthetic construct
ataaaacaagatggaagtgagaag

SEQ ID NO: 6357 - DNA, 24 bp, Artificial Sequence
  Synthetic construct
attagtcgtggtggtccctggaca

SEQ ID NO: 6358 - DNA, 24 bp, Artificial Sequence
  Synthetic construct
attagtagtagtgatactaccata

SEQ ID NO: 6359 - DNA, 24 bp, Artificial Sequence
  Synthetic construct
attgttactagtagtttttacata

SEQ ID NO: 6360 - DNA, 24 bp, Artificial Sequence
  Synthetic construct
attaacagtgatgggactagcaca

SEQ ID NO: 6361 - DNA, 24 bp, Artificial Sequence
  Synthetic construct
ttcagtggcagtggtgatcgttta

SEQ ID NO: 6362 - DNA, 21 bp, Artificial Sequence
  Synthetic construct
atttatgccggtggaagtaca

SEQ ID NO: 6363 - DNA, 24 bp, Artificial Sequence
  Synthetic construct
ctttcctttggcagcgaattctcc

SEQ ID NO: 6364 - DNA, 24 bp, Artificial Sequence
  Synthetic construct
gttagtgttgctggtagtggcaca

SEQ ID NO: 6365 - DNA, 24 bp, Artificial Sequence
  Synthetic construct
gtcgtccctatctttggtacaaca

SEQ ID NO: 6366 - DNA, 24 bp, Artificial Sequence
  Synthetic construct
atgaaccctgccagtggcaacaca

SEQ ID NO: 6367 - DNA, 24 bp, Artificial Sequence
  Synthetic construct
acaatccctatcttcgacatacca

SEQ ID NO: 6368 - DNA, 24 bp, Artificial Sequence
  Synthetic construct
atcgtcgttgccggaatgaagaca

SEQ ID NO: 6369 - DNA, 24 bp, Artificial Sequence
  Synthetic construct
gtagatcctgagaatggtgaaaca

SEQ ID NO: 6370 - DNA, 24 bp, Artificial Sequence
  Synthetic construct
atcaaccctgaaagtggtgtcgca

SEQ ID NO: 6371 - DNA, 24 bp, Artificial Sequence
  Synthetic construct
atcaaccctaacagtggcggcaga

SEQ ID NO: 6372 - DNA, 24 bp, Artificial Sequence
  Synthetic construct
gttgttcctgaagatggtgaaaca

SEQ ID NO: 6373 - DNA, 24 bp, Artificial Sequence
  Synthetic construct
atcaattgtaacagtggtgccaca

SEQ ID NO: 6374 - DNA, 24 bp, Artificial Sequence
  Synthetic construct
atcaaccctagcagtggtggcaca

SEQ ID NO: 6375 - DNA, 24 bp, Artificial Sequence
  Synthetic construct
atcaatgctgacaatggtcgaacg

SEQ ID NO: 6376 - DNA, 24 bp, Artificial Sequence
  Synthetic construct
atcagtggaggtggaggtaccact

SEQ ID NO: 6377 - DNA, 24 bp, Artificial Sequence
  Synthetic construct
atcaaccccagtggtggtggaaca

SEQ ID NO: 6378 - DNA, 24 bp, Artificial Sequence
  Synthetic construct
gtttcgtctgatgcatccaaaaaa

SEQ ID NO: 6379 - DNA, 24 bp, Artificial Sequence
  Synthetic construct
atcctccctgttattgaaaaacca

SEQ ID NO: 6380 - DNA, 24 bp, Artificial Sequence
  Synthetic construct
atcatccctctctttggttcacca

SEQ ID NO: 6381 - DNA, 24 bp, Artificial Sequence
  Synthetic construct
gtcatccctgtacttgggacatca

SEQ ID NO: 6382 - DNA, 24 bp, Artificial Sequence
  Synthetic construct
atcatccccgtgtttggtgcacca

SEQ ID NO: 6383 - DNA, 24 bp, Artificial Sequence
  Synthetic construct
atcagtggtaatagtggttacaag

SEQ ID NO: 6384 - DNA, 24 bp, Artificial Sequence
  Synthetic construct
atcactactagtggtggtaccata

SEQ ID NO: 6385 - DNA, 24 bp, Artificial Sequence
  Synthetic construct
atcaacacctacactgggacccca

SEQ ID NO: 6386 - DNA, 24 bp, Artificial Sequence
  Synthetic construct
ataaacaaagatgggactaagacg

SEQ ID NO: 6387 - DNA, 24 bp, Artificial Sequence
  Synthetic construct
attagtaacagtggtcataaaaca

SEQ ID NO: 6388 - DNA, 24 bp, Artificial Sequence
  Synthetic construct
ataaagcaggatggaagtgaaatc

SEQ ID NO: 6389 - DNA, 30 bp, Artificial Sequence
  Synthetic construct
gtgaaaagtagagttaatagtgggacaaca

SEQ ID NO: 6390 - DNA, 30 bp, Artificial Sequence; identical to SEQ ID NO: 1805
  Synthetic construct

SEQ ID NO: 6391 - DNA, 30 bp, Artificial Sequence
  Synthetic construct
attaaaagcaaaattgatggtgggacggcg

SEQ ID NO: 6392 - DNA, 30 bp, Artificial Sequence
  Synthetic construct
atgaaaaggagatcttatggtgtgacaaca

SEQ ID NO: 6393 - DNA, 24 bp, Artificial Sequence
  Synthetic construct
ctcaaccctagtggtgataccaaa

SEQ ID NO: 6394 - DNA, 24 bp, Artificial Sequence
  Synthetic construct
atttcatttcacggaaacaatgaa

SEQ ID NO: 6395 - DNA, 21 bp, Artificial Sequence
  Synthetic construct
actttctggaatgatgatagg

SEQ ID NO: 6396 - DNA, 24 bp, Artificial Sequence
  Synthetic construct
atcaccgtctatagtggtaacata

SEQ ID NO: 6397 - DNA, 24 bp, Artificial Sequence
  Synthetic construct
acatcttttgatgggagatttaaa

SEQ ID NO: 6398 - DNA, 24 bp, Artificial Sequence
  Synthetic construct
atcaacgctggcaacggttacaca

SEQ ID NO: 6399 - DNA, 24 bp, Artificial Sequence
  Synthetic construct
atgaaccctgaccgaggcaacacg

SEQ ID NO: 6400 - DNA, 24 bp, Artificial Sequence
  Synthetic construct
atcatccctggctttggtgtggtg

SEQ ID NO: 6401 - DNA, 24 bp, Artificial Sequence
  Synthetic construct
gccgtccctgtccttgggacttca

SEQ ID NO: 6402 - DNA, 24 bp, Artificial Sequence
  Synthetic construct
agcattcctatcttgggaacagcg

SEQ ID NO: 6403 - DNA, 21 bp, Artificial Sequence
  Synthetic construct
attttttcgaatggcgaaaaa

SEQ ID NO: 6404 - DNA, 21 bp, Artificial Sequence
  Synthetic construct
attgattgggatgatgataaa

SEQ ID NO: 6405 - DNA, 24 bp, Artificial Sequence
  Synthetic construct
ctcatccctctcttacggatcccc

SEQ ID NO: 6406 - DNA, 24 bp, Artificial Sequence
  Synthetic construct
atcaacccttacaatggtgacaca

SEQ ID NO: 6407 - DNA, 24 bp, Artificial Sequence
  Synthetic construct
atctatcctcgtgactccgatacc

SEQ ID NO: 6408 - DNA, 21 bp, Artificial Sequence
  Synthetic construct
atcactcgaagtggaaacacc

SEQ ID NO: 6409 - DNA, 21 bp, Artificial Sequence
  Synthetic construct
atttatgacgatggcagaaca

SEQ ID NO: 6410 - DNA, 30 bp, Artificial Sequence
  Synthetic construct
attaaaagcaaagcttatggtgggacaaca

SEQ ID NO: 6411 - DNA, 21 bp, Artificial Sequence
  Synthetic construct
attttttcgaatgacgaaaaa

SEQ ID NO: 6412 - DNA, 21 bp, Artificial Sequence
  Synthetic construct
atagattgggatgatgataaa

SEQ ID NO: 6413 - DNA, 21 bp, Artificial Sequence
  Synthetic construct
attttttcgaatgacgccaag

SEQ ID NO: 6414 - DNA, 30 bp, Artificial Sequence
  Synthetic construct
attagaaacttcaattacggtggaacaccg

SEQ ID NO: 6415 - DNA, 21 bp, Artificial Sequence
  Synthetic construct
attgattgggatgatagtaaa

SEQ ID NO: 6416 - DNA, 24 bp, Artificial Sequence
  Synthetic construct
attagtgccacaggtggcggcgcc

SEQ ID NO: 6417 - DNA, 21 bp, Artificial Sequence
  Synthetic construct
attgattgggataatgataga

SEQ ID NO: 6418 - DNA, 21 bp, Artificial Sequence
  Synthetic construct
atttattggaatgatgatgag

SEQ ID NO: 6419 - DNA, 21 bp, Artificial Sequence
  Synthetic construct
atttattggaatgacaataat

SEQ ID NO: 6420 - DNA, 21 bp, Artificial Sequence
  Synthetic construct
atttattggaatgatgataag

SEQ ID NO: 6421 - DNA, 21 bp, Artificial Sequence
  Synthetic construct
atttactggaatgatgataag

SEQ ID NO: 6422 - DNA, 21 bp, Artificial Sequence
  Synthetic construct
atttatgggaatgacgataag

SEQ ID NO: 6423 - DNA, 21 bp, Artificial Sequence
  Synthetic construct
atttatttgactgatgataaa

SEQ ID NO: 6424 - DNA, 21 bp, Artificial Sequence
  Synthetic construct
attaattggaatgatgataag

SEQ ID NO: 6425 - DNA, 24 bp, Artificial Sequence
  Synthetic construct
atcagtgggggtggtcggagtatt

SEQ ID NO: 6426 - DNA, 24 bp, Artificial Sequence
  Synthetic construct
attagtagcagtggtaacactgtg

SEQ ID NO: 6427 - DNA, 21 bp, Artificial Sequence
  Synthetic construct
gtcttttacagtgggaccacc

SEQ ID NO: 6428 - DNA, 27 bp, Artificial Sequence
  Synthetic construct
acatactacaggtccaagtggtatatt

SEQ ID NO: 6429 - DNA, 21 bp, Artificial Sequence
  Synthetic construct
atctattacactgggagcacc

SEQ ID NO: 6430 - DNA, 21 bp, Artificial Sequence
  Synthetic construct
atctcttacagcgggagtacc

SEQ ID NO: 6431 - DNA, 21 bp, Artificial Sequence
  Synthetic construct
atcaatgatggcggaagcacg

SEQ ID NO: 6432 - DNA, 21 bp, Artificial Sequence
  Synthetic construct
atctttcacagtgggaccacc

SEQ ID NO: 6433 - DNA, 21 bp, Artificial Sequence
  Synthetic construct
atctattatagtgggaccacc

SEQ ID NO: 6434 - DNA, 21 bp, Artificial Sequence
  Synthetic construct
atccaaagtggtggaaccacc

SEQ ID NO: 6435 - DNA, 21 bp, Artificial Sequence
  Synthetic construct
atctataccaatgggggcacc

SEQ ID NO: 6436 - DNA, 21 bp, Artificial Sequence
  Synthetic construct
atctatagaagtggatacact

SEQ ID NO: 6437 - DNA, 21 bp, Artificial Sequence
  Synthetic construct
atctataccagtgggatcacc

SEQ ID NO: 6438 - DNA, 21 bp, Artificial Sequence
  Synthetic construct
atccgctacagtggcgccacc

SEQ ID NO: 6439 - DNA, 21 bp, Artificial Sequence
  Synthetic construct
gtctattacaatgagagcatc

SEQ ID NO: 6440 - DNA, 21 bp, Artificial Sequence
  Synthetic construct
atccattatagtggcaacttc

SEQ ID NO: 6441 - DNA, 21 bp, Artificial Sequence
  Synthetic construct
atcttttacagtgggaccacc

SEQ ID NO: 6442 - DNA, 21 bp, Artificial Sequence
  Synthetic construct
atcaatcatagaggaagcacc

SEQ ID NO: 6443 - DNA, 21 bp, Artificial Sequence
  Synthetic construct
atctattacagtgggagcacc

SEQ ID NO: 6444 - DNA, 21 bp, Artificial Sequence
  Synthetic construct
atctattcgaatgggacctcc

SEQ ID NO: 6445 - DNA, 21 bp, Artificial Sequence
  Synthetic construct
attcctactactgggagtagt

SEQ ID NO: 6446 - DNA, 21 bp, Artificial Sequence
  Synthetic construct
atctataccagtgggagcacc

SEQ ID NO: 6447 - DNA, 21 bp, Artificial Sequence
  Synthetic construct
atcgctgccagtggcagctcg

SEQ ID NO: 6448 - DNA, 21 bp, Artificial Sequence
  Synthetic construct
atccatatcagtgggaacacc

SEQ ID NO: 6449 - DNA, 21 bp, Artificial Sequence
  Synthetic construct
atccattacagtggcggcacc

SEQ ID NO: 6450 - DNA, 21 bp, Artificial Sequence
  Synthetic construct
atctattacaatgggaacacc

SEQ ID NO: 6451 - DNA, 21 bp, Artificial Sequence
  Synthetic construct
atttttatcagtgggagcacc

SEQ ID NO: 6452 - DNA, 21 bp, Artificial Sequence
  Synthetic construct
ttgtatagtagcggcaatggt

SEQ ID NO: 6453 - DNA, 21 bp, Artificial Sequence
  Synthetic construct
atcaatcataatggagccacc

SEQ ID NO: 6454 - DNA, 21 bp, Artificial Sequence
  Synthetic construct
atcgatcatagtggcagcacc

SEQ ID NO: 6455 - DNA, 21 bp, Artificial Sequence
  Synthetic construct
atcaatcatcgtggaagcacc

SEQ ID NO: 6456 - DNA, 21 bp, Artificial Sequence
  Synthetic construct
atcaatcatagtggaggcacc

SEQ ID NO: 6457 - DNA, 21 bp, Artificial Sequence
  Synthetic construct
atcagtcatggtggaggcacc

SEQ ID NO: 6458 - DNA, 21 bp, Artificial Sequence
  Synthetic construct
atcaatcaaagtggaagcacc

SEQ ID NO: 6459 - DNA, 21 bp, Artificial Sequence
  Synthetic construct
atcaatcatactggaagcacc

SEQ ID NO: 6460 - DNA, 21 bp, Artificial Sequence
  Synthetic construct
atcaatcatagtggaaccacc

SEQ ID NO: 6461 - DNA, 21 bp, Artificial Sequence
  Synthetic construct
atctataacactgggaccacc

SEQ ID NO: 6462 - DNA, 21 bp, Artificial Sequence
  Synthetic construct
atctcttatactgggagcacc

SEQ ID NO: 6463 - DNA, 21 bp, Artificial Sequence
  Synthetic construct
atctatcatagtgggagcacc

SEQ ID NO: 6464 - DNA, 21 bp, Artificial Sequence
  Synthetic construct
atcttttacagtgggagtgcc

SEQ ID NO: 6465 - DNA, 21 bp, Artificial Sequence
  Synthetic construct
gtttattatactgggaccacc

SEQ ID NO: 6466 - DNA, 21 bp, Artificial Sequence
  Synthetic construct
agttataacaatgagagaacg

SEQ ID NO: 6467 - DNA, 21 bp, Artificial Sequence
  Synthetic construct
atctattacagtgggagcgcc

SEQ ID NO: 6468 - DNA, 21 bp, Artificial Sequence
  Synthetic construct
atctattacagtgggagttcc

SEQ ID NO: 6469 - DNA, 21 bp, Artificial Sequence
  Synthetic construct
atctactacagtgggagcacc

SEQ ID NO: 6470 - DNA, 21 bp, Artificial Sequence
  Synthetic construct
atctattacagtgggggcacc

SEQ ID NO: 6471 - DNA, 21 bp, Artificial Sequence
  Synthetic construct
atctataacagtgcgaacacc

SEQ ID NO: 6472 - DNA, 21 bp, Artificial Sequence
  Synthetic construct
atcgaaaccagtgggagcacc

SEQ ID NO: 6473 - DNA, 21 bp, Artificial Sequence
  Synthetic construct
atgtacaccagtgggcgcacc

SEQ ID NO: 6474 - DNA, 21 bp, Artificial Sequence
  Synthetic construct
atctataccagtgagagcacc

SEQ ID NO: 6475 - DNA, 21 bp, Artificial Sequence
  Synthetic construct
atctctaccagtgggagcacc

SEQ ID NO: 6476 - DNA, 21 bp, Artificial Sequence
  Synthetic construct
atctacaccagtgggaccacc

SEQ ID NO: 6477 - DNA, 21 bp, Artificial Sequence
  Synthetic construct
atcaattacagtgggaccacc

SEQ ID NO: 6478 - DNA, 21 bp, Artificial Sequence
  Synthetic construct
gtccatcacactgggagcacc

SEQ ID NO: 6479 - DNA, 21 bp, Artificial Sequence
  Synthetic construct
gtctactatactgggagcacc

SEQ ID NO: 6480 - DNA, 21 bp, Artificial Sequence
  Synthetic construct
atcaatcatactggaaagtcc

SEQ ID NO: 6481 - DNA, 21 bp, Artificial Sequence
  Synthetic construct
atctatgacactgggagcacc

SEQ ID NO: 6482 - DNA, 21 bp, Artificial Sequence
  Synthetic construct
atcactcatcgcggagacatc

SEQ ID NO: 6483 - DNA, 21 bp, Artificial Sequence
  Synthetic construct
atcagtcatagtggaaccaca

SEQ ID NO: 6484 - DNA, 21 bp, Artificial Sequence
  Synthetic construct
gtcaatcatagtggaagcacc

SEQ ID NO: 6485 - DNA, 21 bp, Artificial Sequence
  Synthetic construct
attaatcatagtggaagcact

SEQ ID NO: 6486 - DNA, 21 bp, Artificial Sequence
  Synthetic construct
atcttctatacggggagcacc

SEQ ID NO: 6487 - DNA, 21 bp, Artificial Sequence
  Synthetic construct
ttctataacagcgggagcgcc

SEQ ID NO: 6488 - DNA, 21 bp, Artificial Sequence
  Synthetic construct
gtggatcacagtgggagttcc

SEQ ID NO: 6489 - DNA, 21 bp, Artificial Sequence
  Synthetic construct
atctacttcggcgggagaacc

SEQ ID NO: 6490 - DNA, 21 bp, Artificial Sequence
  Synthetic construct
atctatactactggaatcgcc

SEQ ID NO: 6491 - DNA, 21 bp, Artificial Sequence
  Synthetic construct
gtctatcataatgggaacacc

SEQ ID NO: 6492 - DNA, 21 bp, Artificial Sequence
  Synthetic construct
atccattatactgggcccgcc

SEQ ID NO: 6493 - DNA, 21 bp, Artificial Sequence
  Synthetic construct
atgtatgagagtggaaacaca

SEQ ID NO: 6494 - DNA, 21 bp, Artificial Sequence
  Synthetic construct
atccattatagtgggaacacc

SEQ ID NO: 6495 - DNA, 21 bp, Artificial Sequence
  Synthetic construct
atctattatagtgggagcacc

SEQ ID NO: 6496 - DNA, 21 bp, Artificial Sequence
  Synthetic construct
atctattatagtgggatcacc

SEQ ID NO: 6497 - DNA, 21 bp, Artificial Sequence
  Synthetic construct
atctattatagtgggagcagc

SEQ ID NO: 6498 - DNA, 21 bp, Artificial Sequence
  Synthetic construct
atctattatagtgggagctcc

SEQ ID NO: 6499 - DNA, 21 bp, Artificial Sequence
  Synthetic construct
gtctattacagtgggagcacc

SEQ ID NO: 6500 - DNA, 21 bp, Artificial Sequence
  Synthetic construct
attcaccacagtgggagcacg

SEQ ID NO: 6501 - DNA, 21 bp, Artificial Sequence
  Synthetic construct
gtatttcatagtgggaaaacc

SEQ ID NO: 6502 - DNA, 21 bp, Artificial Sequence
  Synthetic construct
atgtatcatagtggcagtccc

SEQ ID NO: 6503 - DNA, 21 bp, Artificial Sequence
  Synthetic construct
atctaccatagtgggaaaacc

SEQ ID NO: 6504 - DNA, 21 bp, Artificial Sequence
  Synthetic construct
atctatcatagtgggaacacc

SEQ ID NO: 6505 - DNA, 21 bp, Artificial Sequence
  Synthetic construct
atctatcacagagggaacacc

SEQ ID NO: 6506 - DNA, 21 bp, Artificial Sequence
  Synthetic construct
atgtttcatagtgggaacacc

SEQ ID NO: 6507 - DNA, 21 bp, Artificial Sequence
  Synthetic construct
atctatcatagtgagagcacc

SEQ ID NO: 6508 - DNA, 21 bp, Artificial Sequence
  Synthetic construct
atgtatcccagcgggaacacc

SEQ ID NO: 6509 - DNA, 21 bp, Artificial Sequence
  Synthetic construct
atctttcatagtggaaacacc

SEQ ID NO: 6510 - DNA, 21 bp, Artificial Sequence
  Synthetic construct
atcaatcatggtgggatcacc

SEQ ID NO: 6511 - DNA, 21 bp, Artificial Sequence
  Synthetic construct
gtttatcatagtgggaccacc

SEQ ID NO: 6512 - DNA, 21 bp, Artificial Sequence
  Synthetic construct
atctattatagtggggaaact

SEQ ID NO: 6513 - DNA, 21 bp, Artificial Sequence
  Synthetic construct
atctatcatagtgggaccttc

SEQ ID NO: 6514 - DNA, 21 bp, Artificial Sequence
  Synthetic construct
atctaccacagtgggggcacc

SEQ ID NO: 6515 - DNA, 21 bp, Artificial Sequence
  Synthetic construct
gtctttcatactgggacgacc

SEQ ID NO: 6516 - DNA, 24 bp, Artificial Sequence
  Synthetic construct
atcatcccgatccttggcacagca

SEQ ID NO: 6517 - DNA, 24 bp, Artificial Sequence
  Synthetic construct
atcatccctgtctttggtacaact

SEQ ID NO: 6518 - DNA, 24 bp, Artificial Sequence
  Synthetic construct
atcattcctctctttggaacacca

SEQ ID NO: 6519 - DNA, 24 bp, Artificial Sequence
  Synthetic construct
agcatccctgtccttggcacaaca

SEQ ID NO: 6520 - DNA, 24 bp, Artificial Sequence
  Synthetic construct
atcagtgcttccaacggtcacaca

SEQ ID NO: 6521 - DNA, 24 bp, Artificial Sequence
  Synthetic construct
attagatacgatggggggaagcag

SEQ ID NO: 6522 - DNA, 24 bp, Artificial Sequence
  Synthetic construct
attagtagtggtcgtgttttcatt

SEQ ID NO: 6523 - DNA, 24 bp, Artificial Sequence
  Synthetic construct
attgatcctgacgatggtgaagtt

SEQ ID NO: 6524 - DNA, 21 bp, Artificial Sequence
  Synthetic construct
attggtcgcgggtcttccata

SEQ ID NO: 6525 - DNA, 24 bp, Artificial Sequence
  Synthetic construct
atcagtgggggtggcagaaataca

SEQ ID NO: 6526 - DNA, 24 bp, Artificial Sequence
  Synthetic construct
cttaattggaagggtggtaacata

SEQ ID NO: 6527 - DNA, 24 bp, Artificial Sequence
  Synthetic construct
attactagtggtggtcgtaacata

SEQ ID NO: 6528 - DNA, 24 bp, Artificial Sequence
  Synthetic construct
agtccatatgatggaagcagtcaa

SEQ ID NO: 6529 - DNA, 24 bp, Artificial Sequence
  Synthetic construct
atcaaccctgtcagtggtgacgca

SEQ ID NO: 6530 - DNA, 24 bp, Artificial Sequence
  Synthetic construct
cctgaccctgaagatggcgcaaca

SEQ ID NO: 6531 - DNA, 21 bp, Artificial Sequence
  Synthetic construct
atctacgggaatgatgataag

SEQ ID NO: 6532 - DNA, 24 bp, Artificial Sequence
  Synthetic construct
ttcttccctctccttggaacacca

SEQ ID NO: 6533 - DNA, 24 bp, Artificial Sequence
  Synthetic construct
atttcatatgatggaggtcttaaa

SEQ ID NO: 6534 - DNA, 60 bp, Artificial Sequence
  Synthetic construct
gcgagacatcgggattacgacattttgactggttattatatgggggactactttgactac

SEQ ID NO: 6535 - DNA, 48 bp, Artificial Sequence
  Synthetic construct
gcgagacttaacttggggttcctacagattgggggttcccttgatatc

SEQ ID NO: 6536 - DNA, 51 bp, Artificial Sequence
  Synthetic construct
gcgagagctcggggttattattatgatagtagtggttatcaaattgactac

SEQ ID NO: 6537 - DNA, 57 bp, Artificial Sequence
  Synthetic construct
gcgagagttattactagggcgagtcctggcacagacgggaggtacggtatggacgtc

SEQ ID NO: 6538 - DNA, 81 bp, Artificial Sequence
  Synthetic construct
gcgcggggccacagtagctcgtctcaacggtctagcttcgacggtaactttttatactactactatcaccaaatggacgtc

SEQ ID NO: 6539 - DNA, 63 bp, Artificial Sequence
  Synthetic construct
gtgacttctttaattcggccatattgtagtggcggtgtctgctattcgaactggttcgacccc

SEQ ID NO: 6540 - DNA, 48 bp, Artificial Sequence
  Synthetic construct
gcgagaggtcggggattgcagcaccagctgacagactggttcgacccc

SEQ ID NO: 6541 - DNA, 48 bp, Artificial Sequence
  Synthetic construct
gcgagagtcccccccccgggagtggctaataataagtggttcgacctc

SEQ ID NO: 6542 - DNA, 60 bp, Artificial Sequence
  Synthetic construct
gcgagaggggaaggtccggggacttatatagtctcggggcgatggggctactttgagttc

SEQ ID NO: 6543 - DNA, 33 bp, Artificial Sequence
  Synthetic construct
ggtagaccaggaatggcagaagttggtacttat

SEQ ID NO: 6544 - DNA, 51 bp, Artificial Sequence
  Synthetic construct
gcgaaagatcgcagtagtggctggtaccggggttttggggggattgactac

SEQ ID NO: 6545 - DNA, 33 bp, Artificial Sequence
  Synthetic construct
tcgagaaggagggctgggcccgattttgattac

SEQ ID NO: 6546 - DNA, 39 bp, Artificial Sequence
  Synthetic construct
actacccgacatcaatattgtactactaccaggtgcccc

SEQ ID NO: 6547 - DNA, 30 bp, Artificial Sequence
  Synthetic construct
acggccgcgcgagttgcctggttcgacccc

SEQ ID NO: 6548 - DNA, 39 bp, Artificial Sequence
  Synthetic construct
acgacaatattcggagaagtgttatatccttttgactcc

SEQ ID NO: 6549 - DNA, 48 bp, Artificial Sequence
  Synthetic construct
gcaacagtgtataccaatgcctggtacggaggcgcgggttttgactac

SEQ ID NO: 6550 - DNA, 63 bp, Artificial Sequence
  Synthetic construct
gcgagagcggcaattaaacgggatgggtatggttcggggagttatccagatgctttagacatc

SEQ ID NO: 6551 - DNA, 48 bp, Artificial Sequence
  Synthetic construct
gcgaaacctccgggtaagggagcagtggctggcacctactttgactac

SEQ ID NO: 6552 - DNA, 39 bp, Artificial Sequence
  Synthetic construct
gcgagagatagttgtagtggtggaagttgctatgactac

SEQ ID NO: 6553 - DNA, 39 bp, Artificial Sequence
  Synthetic construct
gcgagacagggtctcggtggtcgggcctcgggagactcc

SEQ ID NO: 6554 - DNA, 51 bp, Artificial Sequence
  Synthetic construct
gcgagatctccacctgcttatgccaactcaataaacaactggttcgacccc

SEQ ID NO: 6555 - DNA, 39 bp, Artificial Sequence
  Synthetic construct
gcgagagataatagtactgggtggtattggtttgatccc

SEQ ID NO: 6556 - DNA, 42 bp, Artificial Sequence
  Synthetic construct
gcgaggggggaccggagcgtttaccccaactggttcgacctc

SEQ ID NO: 6557 - DNA, 42 bp, Artificial Sequence
  Synthetic construct
gcgagagccctctacggtggtcggggacactggttcgacccc

SEQ ID NO: 6558 - DNA, 30 bp, Artificial Sequence
  Synthetic construct
gcgagactggactttcggggagtcctccgc

SEQ ID NO: 6559 - DNA, 54 bp, Artificial Sequence
  Synthetic construct
gcgagagacttaacggaagtggtgggagcttctgtttccgatgcttttgatatc

SEQ ID NO: 6560 - DNA, 60 bp, Artificial Sequence
  Synthetic construct
gcgagaggatccttggcttatgatactagtggttattactaccgcaacttcttcgacccc

SEQ ID NO: 6561 - DNA, 69 bp, Artificial Sequence
  Synthetic construct
gcgagagttcgctacgatttttggagtggttatgagggccggggggaggaccactatcacatggacgtc

SEQ ID NO: 6562 - DNA, 39 bp, Artificial Sequence
  Synthetic construct
gtgacagatagcgcagggagcccctatgcctttgatatt

SEQ ID NO: 6563 - DNA, 45 bp, Artificial Sequence
  Synthetic construct
gcaacaaaaggaggattttccaattctcggggagttatgaacttc

SEQ ID NO: 6564 - DNA, 33 bp, Artificial Sequence
  Synthetic construct
gcgagagggggccgatgggatgcttttgatatc

SEQ ID NO: 6565 - DNA, 48 bp, Artificial Sequence
  Synthetic construct
gcgagagacctcccctatacatattgtggtgatgactgctattccctc

SEQ ID NO: 6566 - DNA, 51 bp, Artificial Sequence
  Synthetic construct
gcgaggggcaagcagctcgtccggttccactactactactacatggacgtc

SEQ ID NO: 6567 - DNA, 69 bp, Artificial Sequence
  Synthetic construct
gcgagaggcaaagggcttgattacgatattttgactggttgggggtggtactactactacatggacgtc

SEQ ID NO: 6568 - DNA, 63 bp, Artificial Sequence
  Synthetic construct
gcgagaggctctagtggttcggggagttattatagctactactactactactacatggacgtc

SEQ ID NO: 6569 - DNA, 39 bp, Artificial Sequence
  Synthetic construct
gcgagatcggattactatgatagtagtggttatggtctc

SEQ ID NO: 6570 - DNA, 36 bp, Artificial Sequence
  Synthetic construct
gcgcgagggactatgatcgcgaaaaactttgactcc

SEQ ID NO: 6571 - DNA, 51 bp, Artificial Sequence
  Synthetic construct
gcgagagccggtcggaggccgccctttagtaaccaccctaattttgactct

SEQ ID NO: 6572 - DNA, 45 bp, Artificial Sequence
  Synthetic construct
gtcgctcggagtcccccagcctacttctactactacatgaatgtc

SEQ ID NO: 6573 - DNA, 36 bp, Artificial Sequence
  Synthetic construct
gcgaggacaaattacggtgaccaatattttgactac

SEQ ID NO: 6574 - DNA, 54 bp, Artificial Sequence
  Synthetic construct
gcgagagcgccggggattgtggcggtcagagccacggagggctggtacgacccc

SEQ ID NO: 6575 - DNA, 51 bp, Artificial Sequence
  Synthetic construct
gcgagagaggtcggttgtagtggtattaactgccagggctggttcgacccc

SEQ ID NO: 6576 - DNA, 63 bp, Artificial Sequence
  Synthetic construct
gcgagagagaaaattgggcccaaaacttacgatattttgactggttacactatctttgactac

SEQ ID NO: 6577 - DNA, 42 bp, Artificial Sequence
  Synthetic construct
gcgagaggggggtatgattacctttgggggagtcatgggtac

SEQ ID NO: 6578 - DNA, 48 bp, Artificial Sequence; identical to SEQ ID NO: 1814
  Synthetic construct

SEQ ID NO: 6579 - DNA, 54 bp, Artificial Sequence
  Synthetic construct
gcgagagatctatggtatgattttgatagcagtgctgcggggtcccttgacgac

SEQ ID NO: 6580 - DNA, 30 bp, Artificial Sequence
  Synthetic construct
gcgacagacctaggagcaccttcggggcac

SEQ ID NO: 6581 - DNA, 45 bp, Artificial Sequence
  Synthetic construct
gcgatagatgtgggggctactgggggggcctactactttgactac

SEQ ID NO: 6582 - DNA, 63 bp, Artificial Sequence
  Synthetic construct
gcgagatgtcgtgtaggtcggacaagtatgtctcagcccctaatcggggctgcttttgatatc

SEQ ID NO: 6583 - DNA, 30 bp, Artificial Sequence
  Synthetic construct
gcgagagcaaggtacactgtggatgactac

SEQ ID NO: 6584 - DNA, 69 bp, Artificial Sequence
  Synthetic construct
gcgagagatggaaattacgatttttggagtggttataacccttttgggtactaccactacatggacgtc

SEQ ID NO: 6585 - DNA, 45 bp, Artificial Sequence
  Synthetic construct
gcgagagccccttcggacgcccattactattactatatggacgtc

SEQ ID NO: 6586 - DNA, 60 bp, Artificial Sequence
  Synthetic construct
gcgagggaaaattacattttacgatatttaccggtggcccggcggggcgctgttgatatc

SEQ ID NO: 6587 - DNA, 51 bp, Artificial Sequence
  Synthetic construct
gctatcttaacattttacgatattttgagtggcccctactcgtttgacttc

SEQ ID NO: 6588 - DNA, 48 bp, Artificial Sequence
  Synthetic construct
gcgagagatggggcccggatagtgggactgactcatgcacttgatatt

SEQ ID NO: 6589 - DNA, 54 bp, Artificial Sequence
  Synthetic construct
gctcggggaaagagacccggctactgcagcggaggcgtctgttcctctgaatat

SEQ ID NO: 6590 - DNA, 54 bp, Artificial Sequence
  Synthetic construct
gctcggggaaagagacccggctactgcagcggaggcgtctgttcctctgactat

SEQ ID NO: 6591 - DNA, 51 bp, Artificial Sequence
  Synthetic construct
gcgagacacccggctacatcaatggctggcatgtggggttacattgacacc

SEQ ID NO: 6592 - DNA, 51 bp, Artificial Sequence
  Synthetic construct
gcgagagtggtgggcgtccgacactgggagcagttctactacatggacgtc

SEQ ID NO: 6593 - DNA, 24 bp, Artificial Sequence
  Synthetic construct
gtgagacgcccctggttcgacccc

SEQ ID NO: 6594 - DNA, 69 bp, Artificial Sequence
  Synthetic construct
gcgacagagggcaaaggcgcaagtaaggcatattgtggggatgagtgctccttctcattctttgaccag

SEQ ID NO: 6595 - DNA, 60 bp, Artificial Sequence
  Synthetic construct
gcgagcctagatgaaagacgaggatacagctatggttaccacttctattacatggacgtc

SEQ ID NO: 6596 - DNA, 54 bp, Artificial Sequence
  Synthetic construct
gcgagagacttaggtatagcagtggctggtaagagggacgatgcttttgatatc

SEQ ID NO: 6597 - DNA, 57 bp, Artificial Sequence
  Synthetic construct
gcgagagagcaaggtcccgaatatagtgggagctactactactactacatggacgtc

SEQ ID NO: 6598 - DNA, 51 bp, Artificial Sequence
  Synthetic construct
gcgttcagcgattactctgatagtagcggctattacttcttttttgactac

SEQ ID NO: 6599 - DNA, 72 bp, Artificial Sequence
  Synthetic construct
gcgagaccctcgggtagggattactctcgttatggttcgggggggcgaaacttctactactacatggacgtc

SEQ ID NO: 6600 - DNA, 54 bp, Artificial Sequence
  Synthetic construct
gcgagagacggggagtattgtggtactgcctgctccatcaactggttcgacccc

SEQ ID NO: 6601 - DNA, 45 bp, Artificial Sequence
  Synthetic construct
gcgagagatttccaggcgtcgatggtgagtcctagggtcgcctac

SEQ ID NO: 6602 - DNA, 33 bp, Artificial Sequence
  Synthetic construct
gcgagagccgactacggttcctctctggacgtc

SEQ ID NO: 6603 - DNA, 51 bp, Artificial Sequence
  Synthetic construct
gcgagagattcagtagtaccagctgctatggagggcaactggttcgacccc

SEQ ID NO: 6604 - DNA, 33 bp, Artificial Sequence
  Synthetic construct
gcgagagctgaccttaatggtgcttttgatatc

SEQ ID NO: 6605 - DNA, 39 bp, Artificial Sequence
  Synthetic construct
gcgagaggggaagtgggagctacggtccggtttgactac

SEQ ID NO: 6606 - DNA, 69 bp, Artificial Sequence
  Synthetic construct
gcgagagtcgtaaagggaaaacagtattacgatattttgactggttattatgagaactggttcgacccc

SEQ ID NO: 6607 - DNA, 60 bp, Artificial Sequence
  Synthetic construct
gcgagatctgaacatccctttgactggttattctgttgcgactactactacatggacgtc

SEQ ID NO: 6608 - DNA, 36 bp, Artificial Sequence
  Synthetic construct
gcgagagtatcgcccgcgacaatgcgggcagtctac

SEQ ID NO: 6609 - DNA, 66 bp, Artificial Sequence
  Synthetic construct
gcggaggactcattttgtggtgatgactgctctcgataccagactcggaggggggcttttaatgtc

SEQ ID NO: 6610 - DNA, 39 bp, Artificial Sequence
  Synthetic construct
gcgagaggggattactttgatagtatcggtttacggtac

SEQ ID NO: 6611 - DNA, 36 bp, Artificial Sequence
  Synthetic construct
gcgagggaatcgggaggcttttcgggttttgacttc

SEQ ID NO: 6612 - DNA, 27 bp, Artificial Sequence
  Synthetic construct
gcgagagaagtagggtggttcgacccc

SEQ ID NO: 6613 - DNA, 42 bp, Artificial Sequence
  Synthetic construct
gcgagagaatcctcgttcgggtgggacaatgtcttggacctt

SEQ ID NO: 6614 - DNA, 48 bp, Artificial Sequence
  Synthetic construct
gcaaatttattttgtgggggtggtaggtgctattccctgtttgactac

SEQ ID NO: 6615 - DNA, 54 bp, Artificial Sequence
  Synthetic construct
gcgaagagatctgggtgggagtacggggggcgttcttcgtactacatggacgtc

SEQ ID NO: 6616 - DNA, 42 bp, Artificial Sequence
  Synthetic construct
gcgagagatcaggggatacagattcgtgatgcttttgatctc

SEQ ID NO: 6617 - DNA, 54 bp, Artificial Sequence
  Synthetic construct
gcgagagaggcagttacggttcggggaattggcttctactaccacatggacgtc

SEQ ID NO: 6618 - DNA, 45 bp, Artificial Sequence
  Synthetic construct
gcgagaggcctagtgggacctcctatttcttcgtacctcgatctc

SEQ ID NO: 6619 - DNA, 63 bp, Artificial Sequence
  Synthetic construct
gcgagaacatattgtggtggtgattgctatttgaggggttggatccctgtttcttttgatatc

SEQ ID NO: 6620 - DNA, 42 bp, Artificial Sequence
  Synthetic construct
gcgagagactccaaacgtattagtctgtctcaggaagactac

SEQ ID NO: 6621 - DNA, 48 bp, Artificial Sequence
  Synthetic construct
gcgagagccgccgagtcggctacatctactcactggtacttcgatctc

SEQ ID NO: 6622 - DNA, 36 bp, Artificial Sequence
  Synthetic construct
gcgcgatcaggcggacccgcggcctggctcgacccc

SEQ ID NO: 6623 - DNA, 27 bp, Artificial Sequence
  Synthetic construct
gcgactcttggtgacgaccataattcc

SEQ ID NO: 6624 - DNA, 45 bp, Artificial Sequence
  Synthetic construct
gcgaccgtcagggagcgcctcggagtctccgggtgcccagcctac

SEQ ID NO: 6625 - DNA, 63 bp, Artificial Sequence
  Synthetic construct
gcaacagatataaaagtccacggtgactacagagggccctacttctactactacatgggcgtc

SEQ ID NO: 6626 - DNA, 48 bp, Artificial Sequence
  Synthetic construct
gcgagagcgtttgtgtatggttcggggagttgggctgcttttgacatt

SEQ ID NO: 6627 - DNA, 45 bp, Artificial Sequence
  Synthetic construct
gcgagagatcgcaaagaattcgaaagacgtcactggttcgacccc

SEQ ID NO: 6628 - DNA, 54 bp, Artificial Sequence
  Synthetic construct
gcgagggtaggggacgataacgatttttggagtggtcattccagctttgacttc

SEQ ID NO: 6629 - DNA, 54 bp, Artificial Sequence
  Synthetic construct
gcgagagatgaaacggatgtgatggggttcagaatggggtactactttgactct

SEQ ID NO: 6630 - DNA, 45 bp, Artificial Sequence
  Synthetic construct
gcaatcgcaggatcagatagtagctctggattttactttgactac

SEQ ID NO: 6631 - DNA, 42 bp, Artificial Sequence
  Synthetic construct
gcaacccagacatatacttcggagagctcccggggtgacttc

SEQ ID NO: 6632 - DNA, 33 bp, Artificial Sequence
  Synthetic construct
gcgggaggccgcgggggatatcacgctgactcc

SEQ ID NO: 6633 - DNA, 51 bp, Artificial Sequence
  Synthetic construct
gcgcgaggacagactgtcggacgatactttaactggttaccccttcaacac

SEQ ID NO: 6634 - DNA, 48 bp, Artificial Sequence
  Synthetic construct
gcgcgacacaggggacgtgggaattctgccggagtggggttcgacccc

SEQ ID NO: 6635 - DNA, 54 bp, Artificial Sequence
  Synthetic construct
gcgagagatctttcggaagtggtgggagctgctgtttccgatgcttttaatgtc

SEQ ID NO: 6636 - DNA, 39 bp, Artificial Sequence
  Synthetic construct
gcgagagcagatggctaccgaaagaaaatccttgactac

SEQ ID NO: 6637 - DNA, 45 bp, Artificial Sequence
  Synthetic construct
gcgagacaatcaggaagtagtggttatatctcctattttaaatac

SEQ ID NO: 6638 - DNA, 45 bp, Artificial Sequence
  Synthetic construct
gcgagaggtataagtggaattacctacccgtatcactttgactac

SEQ ID NO: 6639 - DNA, 63 bp, Artificial Sequence
  Synthetic construct
gcgacattacgtatgatggattattatgatagtagtggtcattatccggactactttgactac

SEQ ID NO: 6640 - DNA, 48 bp, Artificial Sequence
  Synthetic construct
gcgagacgcaacccttatggctccggccggggttataactttgactcc

SEQ ID NO: 6641 - DNA, 36 bp, Artificial Sequence
  Synthetic construct
gcgagaactacccagtatttcttctacatggacgtc

SEQ ID NO: 6642 - DNA, 75 bp, Artificial Sequence
  Synthetic construct
gcgcgacccgatagtggtgacgaactcatcaatccgggccggccaagtggttattacacgggggctattgatctg

SEQ ID NO: 6643 - DNA, 42 bp, Artificial Sequence
  Synthetic construct
gcgagatcagtgaccagtggctggtatggtactctcgactat

SEQ ID NO: 6644 - DNA, 45 bp, Artificial Sequence
  Synthetic construct
gggagaccgcgtaatagtgggagttattatgatgcttttgatata

SEQ ID NO: 6645 - DNA, 45 bp, Artificial Sequence
  Synthetic construct
gcgagacattccttgtctaactttaaacaggcctggttcgacccc

SEQ ID NO: 6646 - DNA, 51 bp, Artificial Sequence
  Synthetic construct
gcgagaaatccgggagatgatagtactggtcacccctcttactttaactac

SEQ ID NO: 6647 - DNA, 45 bp, Artificial Sequence
  Synthetic construct
gcgagacaagagaggcgtatcggcagtggcaaccccttagagttc

SEQ ID NO: 6648 - DNA, 45 bp, Artificial Sequence
  Synthetic construct
gtgagtcccggcgattgtagtggtggtacttgctacccggcctac

SEQ ID NO: 6649 - DNA, 36 bp, Artificial Sequence
  Synthetic construct
gcgagacgatttccgaatagtgaacattttgtctac

SEQ ID NO: 6650 - DNA, 51 bp, Artificial Sequence
  Synthetic construct
gcgagacatgtggcaactcgtccctactacttctactactacatggacgtc

SEQ ID NO: 6651 - DNA, 51 bp, Artificial Sequence
  Synthetic construct
gcgcgacgtaatggttaccatgatagtagtgcttatggcggttttgatatc

SEQ ID NO: 6652 - DNA, 48 bp, Artificial Sequence
  Synthetic construct
gcgagaggggaagatgcctacaatactgagcctgatgcttttgatatc

SEQ ID NO: 6653 - DNA, 36 bp, Artificial Sequence
  Synthetic construct
gcgaaacatgaagcgcgtgattattactttgactcc

SEQ ID NO: 6654 - DNA, 27 bp, Artificial Sequence
  Synthetic construct
gcgagacggaggagcttcgtggacgtc

SEQ ID NO: 6655 - DNA, 66 bp, Artificial Sequence
  Synthetic construct
gcgagaagtagagttgtagtagtaccagctgctatgaccccctactactactactacatggacgtc

SEQ ID NO: 6656 - DNA, 54 bp, Artificial Sequence
  Synthetic construct
gcgagacataagggaaggggacgtatagcagtggctggtaaagcttttgatatc

SEQ ID NO: 6657 - DNA, 36 bp, Artificial Sequence
  Synthetic construct
gcgagacatcggccccactatggcctcatggacgtc

SEQ ID NO: 6658 - DNA, 36 bp, Artificial Sequence
  Synthetic construct
gcgagacgtcaggctggagagggcccctttgactac

SEQ ID NO: 6659 - DNA, 48 bp, Artificial Sequence
  Synthetic construct
gcgagactggattgtagtggtggtagctgctacccgcccatggacgtc

SEQ ID NO: 6660 - DNA, 54 bp, Artificial Sequence
  Synthetic construct
gcgagatccgttcggggagtgggagattactactactactactacatggacgtc

SEQ ID NO: 6661 - DNA, 48 bp, Artificial Sequence
  Synthetic construct
gcgagcgtcggctactatggttcggggagttctgatgcttttgatatc

SEQ ID NO: 6662 - DNA, 69 bp, Artificial Sequence
  Synthetic construct
gcgagacgagggaaggatgataacagtgcttactacttggggaggacccgaggccgggtatttgactat

SEQ ID NO: 6663 - DNA, 33 bp, Artificial Sequence
  Synthetic construct
gcgagacagggcggcagctaccgcattgactac

SEQ ID NO: 6664 - DNA, 51 bp, Artificial Sequence
  Synthetic construct
gcgagagtgggggactacggtgactacggtagctactggtacttcgatctc

SEQ ID NO: 6665 - DNA, 39 bp, Artificial Sequence
  Synthetic construct
gcccagagtgtaactggagctacagatgcttttgatatt

SEQ ID NO: 6666 - DNA, 42 bp, Artificial Sequence
  Synthetic construct
gcgagattggggggtcctacggtgactccccgttttgactac

SEQ ID NO: 6667 - DNA, 45 bp, Artificial Sequence
  Synthetic construct
gcgagactggcgatgaaggaatggagtgtcggtgcttttgatctt

SEQ ID NO: 6668 - DNA, 39 bp, Artificial Sequence
  Synthetic construct
gcgagagacatgtggggccaccactacgcgttcgacccc

SEQ ID NO: 6669 - DNA, 48 bp, Artificial Sequence
  Synthetic construct
gcccgccggtcgcagcagctcctggtccccggatgggcttttgatatc

SEQ ID NO: 6670 - DNA, 42 bp, Artificial Sequence
  Synthetic construct
gcgagacttggggattacagtgtctccgatatggggaactac

SEQ ID NO: 6671 - DNA, 42 bp, Artificial Sequence
  Synthetic construct
acgtttcggggggcctcttgggggagtcttcgttatagctat

SEQ ID NO: 6672 - DNA, 60 bp, Artificial Sequence
  Synthetic construct
gcgaaagatgtggggtattgtagtagtggcagctgcttccgccccctggcttttcaaatc

SEQ ID NO: 6673 - DNA, 45 bp, Artificial Sequence
  Synthetic construct
gccacagatcaatgggggtacggtgacttcgggaactttgactac

SEQ ID NO: 6674 - DNA, 45 bp, Artificial Sequence
  Synthetic construct
acgcgggttttgtggttcgagggacgatatgatacttttgatgtt

SEQ ID NO: 6675 - DNA, 60 bp, Artificial Sequence
  Synthetic construct
gcgtcccgctattgtcgtgctggcagctgctatcaccattactattactatatggacatc

SEQ ID NO: 6676 - DNA, 45 bp, Artificial Sequence
  Synthetic construct
gcgaaagggggcggttgtagtggtgattgctattttcccctcgac

SEQ ID NO: 6677 - DNA, 48 bp, Artificial Sequence
  Synthetic construct
gcgagaggcctggggtattacgatattttgactggtgcttttgactac

SEQ ID NO: 6678 - DNA, 54 bp, Artificial Sequence
  Synthetic construct
gcgaaagatagatcagcctccatatatggtgcggggactcccgcccttgactac

SEQ ID NO: 6679 - DNA, 36 bp, Artificial Sequence
  Synthetic construct
gcgaaagatcgtgacttctactacttcatagacgtc

SEQ ID NO: 6680 - DNA, 45 bp, Artificial Sequence
  Synthetic construct
gcgaaggcgcgcgtaccagctgctatcagattctactttgactcc

SEQ ID NO: 6681 - DNA, 33 bp, Artificial Sequence
  Synthetic construct
gcgagagtcactaggttgaactggttcgacccc

SEQ ID NO: 6682 - DNA, 42 bp, Artificial Sequence
  Synthetic construct
gcgcgaaatgaaggatacagctattctaactacatggacgtc

SEQ ID NO: 6683 - DNA, 60 bp, Artificial Sequence
  Synthetic construct
gcgagatccccccccccctattactacgccagtagtggttattacttcgcctttgactac

SEQ ID NO: 6684 - DNA, 51 bp, Artificial Sequence
  Synthetic construct
gcgagagagaagaacttgtatagtggctacgatccgacgggcttaggctac

SEQ ID NO: 6685 - DNA, 39 bp, Artificial Sequence
  Synthetic construct
gcgacctctggttcgggggcttattataaccctgactac

SEQ ID NO: 6686 - DNA, 57 bp, Artificial Sequence
  Synthetic construct
gcgacagattccacattttacgatgttttgactactatctgggggtactttgactac

SEQ ID NO: 6687 - DNA, 33 bp, Artificial Sequence
  Synthetic construct
gcgacagatagtgcctacgagtactttgactct

SEQ ID NO: 6688 - DNA, 42 bp, Artificial Sequence
  Synthetic construct
gcgagaagggaggcggcgatgagtaatggtaaccttgactac

SEQ ID NO: 6689 - DNA, 54 bp, Artificial Sequence
  Synthetic construct
gcgagagaaccatattgtggtggtgattgcccgccgggatattggttcgacccc

SEQ ID NO: 6690 - DNA, 54 bp, Artificial Sequence
  Synthetic construct
gcgagagaaggggttaggagcggatacagctatgcctttgatgcttttgatatc

SEQ ID NO: 6691 - DNA, 39 bp, Artificial Sequence
  Synthetic construct
gcgagagaatactatggttcggggagttattatacttgg

SEQ ID NO: 6692 - DNA, 48 bp, Artificial Sequence
  Synthetic construct
gcgagagatccgaggaggaatcactatgatagtagtggctctgactac

SEQ ID NO: 6693 - DNA, 36 bp, Artificial Sequence
  Synthetic construct
gcgagagattttttgggagctagctactttgactac

SEQ ID NO: 6694 - DNA, 57 bp, Artificial Sequence
  Synthetic construct
gcgagatccgcccagctctatgatagtagtggttattcggggggcctctttgactac

SEQ ID NO: 6695 - DNA, 48 bp, Artificial Sequence
  Synthetic construct
gcgcctttttcgctctacggggggaactactactactacatggacgtc

SEQ ID NO: 6696 - DNA, 36 bp, Artificial Sequence
  Synthetic construct
gcgacttcggatcggggaacgactacggtgactcct

SEQ ID NO: 6697 - DNA, 78 bp, Artificial Sequence
  Synthetic construct
gcgagattttcggccggaaggcctcaatattgtagtggtggtacctgctaccctccggacttctattacatggacgtc

SEQ ID NO: 6698 - DNA, 51 bp, Artificial Sequence
  Synthetic construct
gcgagagatcgaggtagcagcagctggtacgggggcgatgcttttgatttc

SEQ ID NO: 6699 - DNA, 24 bp, Artificial Sequence
  Synthetic construct
gcgagagggggactacggcgaaac

SEQ ID NO: 6700 - DNA, 33 bp, Artificial Sequence
  Synthetic construct
gcgagagatgaccgctacggtgaccttgatttt

SEQ ID NO: 6701 - DNA, 69 bp, Artificial Sequence
  Synthetic construct
gcgagagggcccaattactatgatagtagaaatcattactcgccaccactcgaccagtacatggacgtc

SEQ ID NO: 6702 - DNA, 30 bp, Artificial Sequence
  Synthetic construct
gcgagcgggaacggtgacttcgtgtacttc

SEQ ID NO: 6703 - DNA, 57 bp, Artificial Sequence
  Synthetic construct
gcgagagaggacagagctgtggctggtccctggtcctcctactacttcatggacgtc

SEQ ID NO: 6704 - DNA, 21 bp, Artificial Sequence
  Synthetic construct
gcgagagacgagaacgactac

SEQ ID NO: 6705 - DNA, 36 bp, Artificial Sequence
  Synthetic construct
gcgagagatacaggatatacccggaaacttgactac

SEQ ID NO: 6706 - DNA, 63 bp, Artificial Sequence
  Synthetic construct
gcgagagatcactacggtggtaaatccggaagcggatactactactactactacatggacgtc

SEQ ID NO: 6707 - DNA, 21 bp, Artificial Sequence
  Synthetic construct
gcgagagctttcctggacgtc

SEQ ID NO: 6708 - DNA, 57 bp, Artificial Sequence
  Synthetic construct
gcgagagggggcgactacgggggaacctgggcgtactactactactacatggacgtc

SEQ ID NO: 6709 - DNA, 60 bp, Artificial Sequence
  Synthetic construct
gcgagaggtccttattactatgatagtagtagttattacccaaaagaatacttccagcac

SEQ ID NO: 6710 - DNA, 60 bp, Artificial Sequence
  Synthetic construct
gcgagagttggtgatgatagtagtggttggggttactactactactactacatggacgtc

SEQ ID NO: 6711 - DNA, 42 bp, Artificial Sequence
  Synthetic construct
gcgagggagaattactatggttcggggagttatttgggctac

SEQ ID NO: 6712 - DNA, 27 bp, Artificial Sequence
  Synthetic construct
gcgaggggttatggttcgggggactac

SEQ ID NO: 6713 - DNA, 54 bp, Artificial Sequence
  Synthetic construct
gcgagagttgggagtctttttgaactaaatggccgggagtcgggtctcgacccc

SEQ ID NO: 6714 - DNA, 48 bp, Artificial Sequence
  Synthetic construct
acgagagttttcggattttcggcttggaacttcggtgacttttactac

SEQ ID NO: 6715 - DNA, 60 bp, Artificial Sequence
  Synthetic construct
gcgagagatcccctttattactatgatagtggtggttattaccatgatgcttttgatatc

SEQ ID NO: 6716 - DNA, 39 bp, Artificial Sequence
  Synthetic construct
gcgagtcgccccgaatatacgtttggttactttgactcc

SEQ ID NO: 6717 - DNA, 36 bp, Artificial Sequence
  Synthetic construct
gcgagagacatagactggaactacggacttgactcc

SEQ ID NO: 6718 - DNA, 51 bp, Artificial Sequence
  Synthetic construct
gcgaaagtgggcaaccgggtcccgacgaggaggggtggggcttttgatatt

SEQ ID NO: 6719 - DNA, 60 bp, Artificial Sequence
  Synthetic construct
gcgagagatcgggcacactgtactaatagcagctgcttttcggggggctggttcgactcc

SEQ ID NO: 6720 - DNA, 60 bp, Artificial Sequence
  Synthetic construct
gcgagaggttgggtggggcaggaccccactgcttaccgcacagggggctactttgactcc

SEQ ID NO: 6721 - DNA, 60 bp, Artificial Sequence
  Synthetic construct
gcgagagatttggacggttactatggttcgggaagttattatcccgatgcttttgatatc

SEQ ID NO: 6722 - DNA, 45 bp, Artificial Sequence
  Synthetic construct
gcgagagtggtcggcagcagctcctactactaccacattgacgtc

SEQ ID NO: 6723 - DNA, 39 bp, Artificial Sequence
  Synthetic construct
gcgagagggggagaatcttactactggtacatggacgtc

SEQ ID NO: 6724 - DNA, 48 bp, Artificial Sequence
  Synthetic construct
gcaagagaagcccgctatggttcggggagcccttggtacatggacgtc

SEQ ID NO: 6725 - DNA, 45 bp, Artificial Sequence
  Synthetic construct
gcgagagccatagagatgtctactacggatggtgctttagatctc

SEQ ID NO: 6726 - DNA, 39 bp, Artificial Sequence
  Synthetic construct
gtgcgtgctgacgactcttatcactactacatgttggac

SEQ ID NO: 6727 - DNA, 63 bp, Artificial Sequence
  Synthetic construct
gtgagagataattactttgatagtagtggttattacctttacggaccccactactttgactac

SEQ ID NO: 6728 - DNA, 60 bp, Artificial Sequence
  Synthetic construct
gcgaggttccacagggaaacatactgtggtggtgattgctattcggggacttttgatgtc

SEQ ID NO: 6729 - DNA, 66 bp, Artificial Sequence
  Synthetic construct
gtgaggggggccccacattcgcagtataccagtttttggttctatagttactacttcatggacgtc

SEQ ID NO: 6730 - DNA, 33 bp, Artificial Sequence
  Synthetic construct
accacagtacataccattaggggctttgactac

SEQ ID NO: 6731 - DNA, 42 bp, Artificial Sequence
  Synthetic construct
gtgcgagcttggcagcaactggtatggggaggtcttgatatc

SEQ ID NO: 6732 - DNA, 57 bp, Artificial Sequence
  Synthetic construct
gcgagagatctccgagatgagagtgttgacgagtactactattactacatggacgtc

SEQ ID NO: 6733 - DNA, 54 bp, Artificial Sequence
  Synthetic construct
gcgagagaagggatggctacaaggggttactactactactactacatggacgtc

SEQ ID NO: 6734 - DNA, 33 bp, Artificial Sequence
  Synthetic construct
gcgagagacctcgtagtaggtgcttttgatatc

SEQ ID NO: 6735 - DNA, 72 bp, Artificial Sequence
  Synthetic construct
gcgagaggccatgatagtagtggttattacttttttttgggggtgggctactactactactacatggacgtc

SEQ ID NO: 6736 - DNA, 57 bp, Artificial Sequence
  Synthetic construct
gcgagaggtcttatagcagatagtagtggttattacaagttacggctatttgactac

SEQ ID NO: 6737 - DNA, 39 bp, Artificial Sequence
  Synthetic construct
gcgagatcaccaacgggttatccctactactttgactac

SEQ ID NO: 6738 - DNA, 39 bp, Artificial Sequence
  Synthetic construct
gcgagagatcctgactatgatactagtggtccagactac

SEQ ID NO: 6739 - DNA, 39 bp, Artificial Sequence
  Synthetic construct
gcgagagatgatggaggggggtactggggcttagacctc

SEQ ID NO: 6740 - DNA, 75 bp, Artificial Sequence
  Synthetic construct
gcgtccctaggacattgtcgtagtggcagctgtttagtccgaccagctgaggtctcgcagacctggttcgacccc

SEQ ID NO: 6741 - DNA, 48 bp, Artificial Sequence
  Synthetic construct
gcgaaagatcgcagcctctccggatatagcagcagttgccacctcgac

SEQ ID NO: 6742 - DNA, 48 bp, Artificial Sequence
  Synthetic construct
gcgagaggcctttatgagggatttgaatcaagtggtttttacagattc

SEQ ID NO: 6743 - DNA, 39 bp, Artificial Sequence
  Synthetic construct
gttaaagctgagggcccgtatggtggctactttgaccaa

SEQ ID NO: 6744 - DNA, 39 bp, Artificial Sequence
  Synthetic construct
gcgaaagtgaagtttggctatggctcccattttgatatc

SEQ ID NO: 6745 - DNA, 45 bp, Artificial Sequence
  Synthetic construct
gctagagtagaatcgtactactatgacagtagtgctgttgactac

SEQ ID NO: 6746 - DNA, 51 bp, Artificial Sequence
  Synthetic construct
gcgaaatacaaccctcggggctacggtgactacgcggggtacctcgacccc

SEQ ID NO: 6747 - DNA, 45 bp, Artificial Sequence
  Synthetic construct
gcgaaaatcaggccaatgactacggtgacgagctcctttgactac

SEQ ID NO: 6748 - DNA, 54 bp, Artificial Sequence
  Synthetic construct
gcgagagataccgctacattacgaagtcacgggggggccggctggttcgccccc

SEQ ID NO: 6749 - DNA, 48 bp, Artificial Sequence
  Synthetic construct
gcgaaaccggggggctatggttcggggagtgatggtgcttttgatatc

SEQ ID NO: 6750 - DNA, 45 bp, Artificial Sequence
  Synthetic construct
acgaatattcgagacgcatacagtgtcggttatggacttgattcc

SEQ ID NO: 6751 - DNA, 42 bp, Artificial Sequence
  Synthetic construct
gcgaaaaggcaggcttatagcagctcgtcccccttgggccac

SEQ ID NO: 6752 - DNA, 51 bp, Artificial Sequence
  Synthetic construct
gcgaaagatgtcagcaactacgggatttactattactactacatggacgtc

SEQ ID NO: 6753 - DNA, 42 bp, Artificial Sequence
  Synthetic construct
gcgagttcggatgactacagtaactacggtccatttgactac

SEQ ID NO: 6754 - DNA, 48 bp, Artificial Sequence
  Synthetic construct
gctagaggtccccccagtggatacacctttggttcctactttgactcc

SEQ ID NO: 6755 - DNA, 48 bp, Artificial Sequence
  Synthetic construct
gcgagaggagtcactagtggttaccactcttaccccctccttgacttc

SEQ ID NO: 6756 - DNA, 60 bp, Artificial Sequence
  Synthetic construct
gcccgagctcggggaacatataactgggactctggggcctactcttacttcatggacgtc

SEQ ID NO: 6757 - DNA, 45 bp, Artificial Sequence
  Synthetic construct
gcgaaaattaggccaatgactacggtgacgagcgcgtttgacctc

SEQ ID NO: 6758 - DNA, 33 bp, Artificial Sequence
  Synthetic construct
ggaagagatccgggatacagtagcttggacgtc

SEQ ID NO: 6759 - DNA, 60 bp, Artificial Sequence
  Synthetic construct
gctcgaggtcggggaacctatgactggaactccggggcctactactacttcatggacgtg

SEQ ID NO: 6760 - DNA, 78 bp, Artificial Sequence
  Synthetic construct
acgagaggaggcggccatttgctccgggcaggctatgagtggtccccgggagatcaaacattccacttcatgaacgtc

SEQ ID NO: 6761 - DNA, 30 bp, Artificial Sequence
  Synthetic construct
gcgacttatcccacgggcattttgaactcc

SEQ ID NO: 6762 - DNA, 39 bp, Artificial Sequence
  Synthetic construct
gcggcctcttacaatatccagggtttggtccttgactac

SEQ ID NO: 6763 - DNA, 45 bp, Artificial Sequence
  Synthetic construct
gcgaaacacaaaggggagtcctatatttcttgggctcttgatttg

SEQ ID NO: 6764 - DNA, 54 bp, Artificial Sequence
  Synthetic construct
gcgaaaaccccctcaagaagtgtaagcagtagctggccctattactttgactat

SEQ ID NO: 6765 - DNA, 66 bp, Artificial Sequence
  Synthetic construct
gcgaggaacgtatattgtagtggtggtagctgctactccgactactactactactacatggacgtc

SEQ ID NO: 6766 - DNA, 48 bp, Artificial Sequence
  Synthetic construct
gcgagaccagaaagtgggagctactactcgccctggttcttcgaatgc

SEQ ID NO: 6767 - DNA, 42 bp, Artificial Sequence
  Synthetic construct
gcgagagacaagtatagtgggaccacggatgcttttgatatc

SEQ ID NO: 6768 - DNA, 45 bp, Artificial Sequence
  Synthetic construct
gcgagagacccacgagcgtataccgatccccgctggttcgacccc

SEQ ID NO: 6769 - DNA, 39 bp, Artificial Sequence
  Synthetic construct
gcgagagcgggggggttcatggttcggggactcgactac

SEQ ID NO: 6770 - DNA, 57 bp, Artificial Sequence
  Synthetic construct
gcgagagaaataagaggcgtgggctatagtagtggttattacggctggttcgacccc

SEQ ID NO: 6771 - DNA, 39 bp, Artificial Sequence
  Synthetic construct
gcgagagtccgtacgtccctctactactacatggacgtc

SEQ ID NO: 6772 - DNA, 45 bp, Artificial Sequence
  Synthetic construct
gcgagagatggtgtactactacgaagcttaaagcggttcgacccc

SEQ ID NO: 6773 - DNA, 39 bp, Artificial Sequence
  Synthetic construct
gcgagagggtgggcaacagatggctactacatggacctc

SEQ ID NO: 6774 - DNA, 66 bp, Artificial Sequence
  Synthetic construct
gcgaaagggggtccagatgcggctgtctggacgaattctcaactctcttttcatccctttgtctcg

SEQ ID NO: 6775 - DNA, 42 bp, Artificial Sequence
  Synthetic construct
gcgaaagtaagactgatacggcccgaggggttctttgactat

SEQ ID NO: 6776 - DNA, 54 bp, Artificial Sequence
  Synthetic construct
gcgaaagacctctcttgtggtggtggtagctgtttttcccgggtttctgactac

SEQ ID NO: 6777 - DNA, 84 bp, Artificial Sequence
  Synthetic construct
gcgagaggcaaaacttcttactatgatagagacaaaccgttttactatgatagtagtggtaagggtccccactgctttgactac

SEQ ID NO: 6778 - DNA, 48 bp, Artificial Sequence
  Synthetic construct
accacagattggggttcgacgactcattatattcaggcttttgatatc

SEQ ID NO: 6779 - DNA, 45 bp, Artificial Sequence
  Synthetic construct
actagagattgggactactatgatagtagtggttactccagtcac

SEQ ID NO: 6780 - DNA, 57 bp, Artificial Sequence
  Synthetic construct
actagaccggcggctgatagcagcagctggtacagccgccttacctactttgactac

SEQ ID NO: 6781 - DNA, 36 bp, Artificial Sequence
  Synthetic construct
actagagagctctccatagagggagcttttgatatc

SEQ ID NO: 6782 - DNA, 51 bp, Artificial Sequence
  Synthetic construct
actagagatcttctcggggtcttctcggaggggattggttggttcgacccc

SEQ ID NO: 6783 - DNA, 54 bp, Artificial Sequence
  Synthetic construct
actagagccccggggaggggatttaggtatggttcggggagccactttgactac

SEQ ID NO: 6784 - DNA, 42 bp, Artificial Sequence
  Synthetic construct
gcgagaggggtggctacgacctaccaatatcactttgacttc

SEQ ID NO: 6785 - DNA, 57 bp, Artificial Sequence
  Synthetic construct
gcgagagatcgcatcagttttacgactggtgtggtcccggactggaacttcgatctc

SEQ ID NO: 6786 - DNA, 54 bp, Artificial Sequence
  Synthetic construct
gcgaaacatttaacgaccagtattgttgtggtggtagctgcacgatttgtctcc

SEQ ID NO: 6787 - DNA, 42 bp, Artificial Sequence
  Synthetic construct
gcgaagttggactacagtaacttacgacagagatttgactac

SEQ ID NO: 6788 - DNA, 36 bp, Artificial Sequence
  Synthetic construct
gcgaaagatccctcctctatagtgggagccttcgac

SEQ ID NO: 6789 - DNA, 27 bp, Artificial Sequence
  Synthetic construct
gcgaagcctatagcaggtcgtccttcc

SEQ ID NO: 6790 - DNA, 45 bp, Artificial Sequence
  Synthetic construct
gcgaaaccgaaggaggaagagccctcatactactacatggacgtc

SEQ ID NO: 6791 - DNA, 33 bp, Artificial Sequence
  Synthetic construct
gcgaaagataaacgggctgcccccttagactac

SEQ ID NO: 6792 - DNA, 51 bp, Artificial Sequence
  Synthetic construct
gcgaaagattactatggttcggggacttattatatgggagcttttgatatc

SEQ ID NO: 6793 - DNA, 42 bp, Artificial Sequence
  Synthetic construct
gccagggaggacagcagtggctggtatgatgcttttgatatc

SEQ ID NO: 6794 - DNA, 45 bp, Artificial Sequence
  Synthetic construct
gcgaaacgggggcctgatagtagtgggtcgggcgcttttgatatc

SEQ ID NO: 6795 - DNA, 42 bp, Artificial Sequence
  Synthetic construct
gcgaaagagggtagtggttattactcaaactggttcgacccc

SEQ ID NO: 6796 - DNA, 51 bp, Artificial Sequence
  Synthetic construct
gcgaaagatcgagggaagatttactatgatagtagtggccaacaggactac

SEQ ID NO: 6797 - DNA, 54 bp, Artificial Sequence
  Synthetic construct
gcgaaagatcgggcattacgatattttgactggttatttgatgcttttgatatc

SEQ ID NO: 6798 - DNA, 39 bp, Artificial Sequence
  Synthetic construct
gcgaaagccccaggatatagcaatactgcttttgatttc

SEQ ID NO: 6799 - DNA, 45 bp, Artificial Sequence
  Synthetic construct
gcgaaagtcggggacgtattacgatattttgactggtatgactac

SEQ ID NO: 6800 - DNA, 42 bp, Artificial Sequence
  Synthetic construct
gcgaaatgggggctatggttcggggagttggactttgactac

SEQ ID NO: 6801 - DNA, 45 bp, Artificial Sequence
  Synthetic construct
gcgaatcccgattacgatattttgactgtgaactggttcgacccc

SEQ ID NO: 6802 - DNA, 30 bp, Artificial Sequence
  Synthetic construct
gcgaatcttataggagggtactttggctac

SEQ ID NO: 6803 - DNA, 63 bp, Artificial Sequence
  Synthetic construct
gcgaagacagcatattgtggtggggattgctcttctagagtcactgcatacttctttgactcc

SEQ ID NO: 6804 - DNA, 42 bp, Artificial Sequence
  Synthetic construct
gcgaaatcccgggcagtggctgggtacgattactttgactac

SEQ ID NO: 6805 - DNA, 42 bp, Artificial Sequence
  Synthetic construct
gcgagaaggcagggctacagtagttcgtccccgttgaaatac

SEQ ID NO: 6806 - DNA, 54 bp, Artificial Sequence
  Synthetic construct
gcgagagacttttggggttactatggttcggggattagaaaagagtttgatatc

SEQ ID NO: 6807 - DNA, 54 bp, Artificial Sequence
  Synthetic construct
gcgagtcgaggaattaacggggggttcggggaagatgaggaatacttccaccac

SEQ ID NO: 6808 - DNA, 42 bp, Artificial Sequence; identical to SEQ ID NO: 1813
  Synthetic construct

SEQ ID NO: 6809 - DNA, 60 bp, Artificial Sequence
  Synthetic construct
gcgagagatgggtcttgtgattacatttgggggggttatcgttatgatgcttttgatatt

SEQ ID NO: 6810 - DNA, 51 bp, Artificial Sequence
  Synthetic construct
gcgagccatccttatgggaggtatagcagtggctggggggcctttgactac

SEQ ID NO: 6811 - DNA, 60 bp, Artificial Sequence
  Synthetic construct
gcgagacagcgaagcgagtggatagtagtggttattacgggctactactacatggacgtc

SEQ ID NO: 6812 - DNA, 66 bp, Artificial Sequence
  Synthetic construct
gcgagagatcgcggacaccccaattactatggttcggggagttattaccgctactactttgactac

SEQ ID NO: 6813 - DNA, 33 bp, Artificial Sequence
  Synthetic construct
gcgcgacggtcgtatagtggctactttgactcc

SEQ ID NO: 6814 - DNA, 30 bp, Artificial Sequence
  Synthetic construct
gcgaccctgaagtggaattccttagactcc

SEQ ID NO: 6815 - DNA, 51 bp, Artificial Sequence
  Synthetic construct
accacagggttcgattttggagtggttattattgtcgatggcatggacgtc

SEQ ID NO: 6816 - DNA, 63 bp, Artificial Sequence
  Synthetic construct
accacagtcccttattgtagtggtggtagctgctacggggactactactactacatggacgtc

SEQ ID NO: 6817 - DNA, 54 bp, Artificial Sequence
  Synthetic construct
accacctcaatcgaattactatggttcggggagcccctcggcgcttttgatatc

SEQ ID NO: 6818 - DNA, 45 bp, Artificial Sequence
  Synthetic construct
accactttacggtcaggggactactacttctactacatggacgtc

SEQ ID NO: 6819 - DNA, 42 bp, Artificial Sequence
  Synthetic construct
accacagagggcggcagtggctggtttgggtactttgactac

SEQ ID NO: 6820 - DNA, 24 bp, Artificial Sequence
  Synthetic construct
agtagagactggggcattgcactc

SEQ ID NO: 6821 - DNA, 60 bp, Artificial Sequence
  Synthetic construct
gcgaaagatgggggaagaacgtcttactatgatactagtgcttattactactttgactac

SEQ ID NO: 6822 - DNA, 63 bp, Artificial Sequence
  Synthetic construct
gcgagagaagatcgtggatattgtagtagtggtagctgctactttgtagggacctttgactac

SEQ ID NO: 6823 - DNA, 27 bp, Artificial Sequence
  Synthetic construct
gcgcgagggtcccgggaggttctctac

SEQ ID NO: 6824 - DNA, 54 bp, Artificial Sequence
  Synthetic construct
gcgagaggaggggcccattattgtggtggtgactgcccgagggcttttgacatc

SEQ ID NO: 6825 - DNA, 33 bp, Artificial Sequence
  Synthetic construct
gcgagtctctggtcccgttactactttgacttc

SEQ ID NO: 6826 - DNA, 42 bp, Artificial Sequence
  Synthetic construct
gcgagagcgacgggtgggaccttctactaccatatggacgtc

SEQ ID NO: 6827 - DNA, 81 bp, Artificial Sequence
  Synthetic construct
gtaaaacaggctctgaatactgggtacgattcgactttttcaccctttgtctctatctactactacttctacatggacgtc

SEQ ID NO: 6828 - DNA, 48 bp, Artificial Sequence
  Synthetic construct
gggagactctgccaggcgttttggtccggggaacattgtggggactcc

SEQ ID NO: 6829 - DNA, 57 bp, Artificial Sequence
  Synthetic construct
gcgacacacgtctcgctccattgtggttctaattgctattcggaatatttccatcac

SEQ ID NO: 6830 - DNA, 33 bp, Artificial Sequence
  Synthetic construct
atttcggctgctacggatgagctctttgagtac

SEQ ID NO: 6831 - DNA, 54 bp, Artificial Sequence
  Synthetic construct
tcaaagaatcagtttgatagtagtggttattacttaggaggggcttttgatatc

SEQ ID NO: 6832 - DNA, 54 bp, Artificial Sequence
  Synthetic construct
gcgaaaaccacgacgttttattatgataatagtgacctttttgcttttgatatc

SEQ ID NO: 6833 - DNA, 45 bp, Artificial Sequence
  Synthetic construct
gcgagagaggcaggtggctggtcctctcacaactggttcgacccc

SEQ ID NO: 6834 - DNA, 33 bp, Artificial Sequence
  Synthetic construct
gcgagagaagggcattccgaaggttttgatatt

SEQ ID NO: 6835 - DNA, 63 bp, Artificial Sequence
  Synthetic construct
accacaggactaggaagcgatgataatagtgattattttatgaacattgatggttttaatatc

SEQ ID NO: 6836 - DNA, 51 bp, Artificial Sequence
  Synthetic construct
gcgagagtttttaggactggagactattggaggggacttctgtgggactac

SEQ ID NO: 6837 - DNA, 81 bp, Artificial Sequence
  Synthetic construct
gcggctcatctgaggggggcgacagatggcggtttttggagtggccttgcgcgtttgaagtcctgggggtggctcgacccc

SEQ ID NO: 6838 - DNA, 51 bp, Artificial Sequence
  Synthetic construct
accacagattttcggttcgatgacagtggttactacaactacttagataac

SEQ ID NO: 6839 - DNA, 51 bp, Artificial Sequence
  Synthetic construct
gcgaaagagggtggacgtggatatagttccttcgataattactttgactat

SEQ ID NO: 6840 - DNA, 30 bp, Artificial Sequence
  Synthetic construct
gcgagaaatagtgcccagccctttgactcc

SEQ ID NO: 6841 - DNA, 63 bp, Artificial Sequence
  Synthetic construct
gcgagagatatcgcccctcattactatgatagtagtgcttattcacccgatgcttttgatatc

SEQ ID NO: 6842 - DNA, 42 bp, Artificial Sequence
  Synthetic construct
gcgaaacggcaggggtatagtagctcgtccccgttggggtcc

SEQ ID NO: 6843 - DNA, 42 bp, Artificial Sequence
  Synthetic construct
gcgaaacgacaggggtatagtagctcgtccccgttggggtcc

SEQ ID NO: 6844 - DNA, 51 bp, Artificial Sequence
  Synthetic construct
gcgagagtcggctgtagtggtgatcattgctatggatattactttgactac

SEQ ID NO: 6845 - DNA, 33 bp, Artificial Sequence
  Synthetic construct
gcaaccctctctgcccctgttatctcccgtcac

SEQ ID NO: 6846 - DNA, 45 bp, Artificial Sequence
  Synthetic construct
gcgagagggcgcagtgactggttgactggaggaggttttgatatt

SEQ ID NO: 6847 - DNA, 36 bp, Artificial Sequence
  Synthetic construct
gcaagagaggactacggtggtaaaccccaggcctac

SEQ ID NO: 6848 - DNA, 33 bp, Artificial Sequence
  Synthetic construct
gcgagaggtttgtccgcagtggctggttcgggg

SEQ ID NO: 6849 - DNA, 48 bp, Artificial Sequence
  Synthetic construct
gcgcgagttcagcatgatagtagtggttattattctggccttgacttc

SEQ ID NO: 6850 - DNA, 54 bp, Artificial Sequence
  Synthetic construct
gcgaggcgatacaccggtgcctggtcctacttcacgtaccactacttggacgtc

SEQ ID NO: 6851 - DNA, 51 bp, Artificial Sequence
  Synthetic construct
gcgaaaccgcgggtgaactttggttcggggagaggagacgattttgatatc

SEQ ID NO: 6852 - DNA, 45 bp, Artificial Sequence
  Synthetic construct
gcgagaaattttggagtgattcttataggagatgcctttgatctc

SEQ ID NO: 6853 - DNA, 57 bp, Artificial Sequence
  Synthetic construct
gtcagaggcgattcagttcacttcgataggaatgcatattatgggggatttgatgtc

SEQ ID NO: 6854 - DNA, 48 bp, Artificial Sequence
  Synthetic construct
gcgagagatccccctagtgagtgggaggtaacgttctactttgactac

SEQ ID NO: 6855 - DNA, 54 bp, Artificial Sequence
  Synthetic construct
gcgagagacggtgcgtccatttttatcgaagtaattaatttctacatggacgtc

SEQ ID NO: 6856 - DNA, 45 bp, Artificial Sequence
  Synthetic construct
gcgcgccggttttgtagtggtggtagctgctactctcttgaatat

SEQ ID NO: 6857 - DNA, 45 bp, Artificial Sequence
  Synthetic construct
gtgaaggattcgggttcggggaggatcatttccctgcttgacttc

SEQ ID NO: 6858 - DNA, 42 bp, Artificial Sequence
  Synthetic construct
gcgagaggtcccggatacagctatgacatccagtttgactac

SEQ ID NO: 6859 - DNA, 42 bp, Artificial Sequence
  Synthetic construct
gcgagaagtcacggagatggctacaattcttactttgactac

SEQ ID NO: 6860 - DNA, 39 bp, Artificial Sequence
  Synthetic construct
gcgaaagactattatggttcggggagttattgcgactac

SEQ ID NO: 6861 - DNA, 66 bp, Artificial Sequence
  Synthetic construct
gcgagagccaacacctattactttacctcggggacttattataacaatgacgactaccttgactcc

SEQ ID NO: 6862 - DNA, 42 bp, Artificial Sequence
  Synthetic construct
ggaagagattttgggagatggccgcccaggggacttgactac

SEQ ID NO: 6863 - DNA, 39 bp, Artificial Sequence
  Synthetic construct
gcgaaagacatgtttgatattagtggtctcaatgactac

SEQ ID NO: 6864 - DNA, 42 bp, Artificial Sequence
  Synthetic construct
gcgaaagatcgggatgactacggtgactactactttgactac

SEQ ID NO: 6865 - DNA, 45 bp, Artificial Sequence
  Synthetic construct
gcgagagcccaaacccattactatgatagtagagggtttggcgac

SEQ ID NO: 6866 - DNA, 42 bp, Artificial Sequence
  Synthetic construct
gcgagagatcggtttgtagaggctacgaccacggcggacttc

SEQ ID NO: 6867 - DNA, 60 bp, Artificial Sequence
  Synthetic construct
gcgagagtggagaggacaccctcatccggggcactctactactactactacatggacgtc

SEQ ID NO: 6868 - DNA, 57 bp, Artificial Sequence
  Synthetic construct
gcgaaagagggtggatatagtggctacggttactactactactactacatggacgtc

SEQ ID NO: 6869 - DNA, 42 bp, Artificial Sequence
  Synthetic construct
gcgaaagatccgaactcgggcagcagtggccaccttgactac

SEQ ID NO: 6870 - DNA, 45 bp, Artificial Sequence
  Synthetic construct
gcgaaagatgtggttcggggagttgactactactacatggacgtc

SEQ ID NO: 6871 - DNA, 60 bp, Artificial Sequence
  Synthetic construct
gcgagagatcggagtagttactatgatagtagtggttattacctaaactggttcgacccc

SEQ ID NO: 6872 - DNA, 54 bp, Artificial Sequence
  Synthetic construct
gcgagagattactgtagtagtaccagctgccctttctactactacatggacgtc

SEQ ID NO: 6873 - DNA, 60 bp, Artificial Sequence
  Synthetic construct
gcgagagctcacggcgaaggatattgtactaatggtgtatgttcctcctactttgactac

SEQ ID NO: 6874 - DNA, 33 bp, Artificial Sequence
  Synthetic construct
gcgaaagacgccaatggtggctggtatgactac

SEQ ID NO: 6875 - DNA, 36 bp, Artificial Sequence
  Synthetic construct
gcgttctttccctcgggcagttatgcctttcacatt

SEQ ID NO: 6876 - DNA, 57 bp, Artificial Sequence
  Synthetic construct
gcaagggatcagtattactctgaaactactgcttattacttcaaatacttccaacac

SEQ ID NO: 6877 - DNA, 57 bp, Artificial Sequence
  Synthetic construct
gcgaaagtcggttatggtatcagttggtacttgggctactactactacatggacgac

SEQ ID NO: 6878 - DNA, 57 bp, Artificial Sequence
  Synthetic construct
gcgagagctttcgggaatttttttgattggtcctcccgggactattacatggacgtc

SEQ ID NO: 6879 - DNA, 39 bp, Artificial Sequence
  Synthetic construct
gcgcgagggggggcctacgaaatgacctggtttgacacc

SEQ ID NO: 6880 - DNA, 54 bp, Artificial Sequence
  Synthetic construct
gcgcgagatcatatggtgtctgcttcctcctacaactccttctacatggacgtc

SEQ ID NO: 6881 - DNA, 42 bp, Artificial Sequence
  Synthetic construct
gcgagcatgaccatggttcggacgaataactggttcgacctc

SEQ ID NO: 6882 - DNA, 48 bp, Artificial Sequence
  Synthetic construct
gcgacagataggcattcctatcattcggggagttttgttcttgacttc

SEQ ID NO: 6883 - DNA, 42 bp, Artificial Sequence
  Synthetic construct
gcgaaaaagtttggccgcggactgtctgatgtttttgatatg

SEQ ID NO: 6884 - DNA, 27 bp, Artificial Sequence
  Synthetic construct
gcgctatattggaattatgtcctcgag

SEQ ID NO: 6885 - DNA, 45 bp, Artificial Sequence
  Synthetic construct
actagacatctggatttcaatagtgacccgtcggggggggactac

SEQ ID NO: 6886 - DNA, 45 bp, Artificial Sequence
  Synthetic construct
gcaaaatccccctcccctgaggtgggaactacaccctttgactac

SEQ ID NO: 6887 - DNA, 45 bp, Artificial Sequence
  Synthetic construct
gcaaaggacctagcagcagctggcacttatgatgcttttgaaaaa

SEQ ID NO: 6888 - DNA, 42 bp, Artificial Sequence
  Synthetic construct
gtaaaagatctcgcgagcggtatggttcagggttttgatatc

SEQ ID NO: 6889 - DNA, 54 bp, Artificial Sequence
  Synthetic construct
gcaaaagattcccacccttcttatggttcggggagttgggatgcttttgatatc

SEQ ID NO: 6890 - DNA, 51 bp, Artificial Sequence
  Synthetic construct
gcaagagatataaacccctatagcagtggctgggtgtcctactttgactac

SEQ ID NO: 6891 - DNA, 57 bp, Artificial Sequence
  Synthetic construct
gcaaaggataggggattacgtttgggggagttatcgcggggtcactactttgacttg

SEQ ID NO: 6892 - DNA, 39 bp, Artificial Sequence
  Synthetic construct
gcaaaagacagtagtggatataatgatgcttttgagatc

SEQ ID NO: 6893 - DNA, 39 bp, Artificial Sequence
  Synthetic construct
gtgaaagataaaacccgtggccatcagtacttccaacac

SEQ ID NO: 6894 - DNA, 36 bp, Artificial Sequence
  Synthetic construct
gcaaaagatgagggatttttgactggtttttctcat

SEQ ID NO: 6895 - DNA, 42 bp, Artificial Sequence
  Synthetic construct
gcaacaccctcgcgtagggggtggttattatgggttgactac

SEQ ID NO: 6896 - DNA, 36 bp, Artificial Sequence
  Synthetic construct
gcaacagaaggatatagtggctacgactttgactac

SEQ ID NO: 6897 - DNA, 24 bp, Artificial Sequence
  Synthetic construct
gcaacagatacccctattcgggag

SEQ ID NO: 6898 - DNA, 39 bp, Artificial Sequence
  Synthetic construct
gcaacagatcagggtagtggttattactactttgactac

SEQ ID NO: 6899 - DNA, 36 bp, Artificial Sequence
  Synthetic construct
gcaacagccaacattggggctattactatagcctac

SEQ ID NO: 6900 - DNA, 33 bp, Artificial Sequence
  Synthetic construct
gcaacagccgctagtagtggttattttttctac

SEQ ID NO: 6901 - DNA, 60 bp, Artificial Sequence
  Synthetic construct
gcaacagcgggtggttacgatattttgactggttattatagccccggtgcttttgatatc

SEQ ID NO: 6902 - DNA, 48 bp, Artificial Sequence
  Synthetic construct
gcaactgtaactactgggaggggctactactactactacatggacgtc

SEQ ID NO: 6903 - DNA, 39 bp, Artificial Sequence
  Synthetic construct
gcaaggaggcattacgatattttgacttcggtcgacccc

SEQ ID NO: 6904 - DNA, 36 bp, Artificial Sequence
  Synthetic construct
gcaatggttatggctacaatgaggagggttgactac

SEQ ID NO: 6905 - DNA, 36 bp, Artificial Sequence
  Synthetic construct
gcgacgcacttcgacggctacaatctacccgactac

SEQ ID NO: 6906 - DNA, 33 bp, Artificial Sequence
  Synthetic construct
gtgaccctctctgcccctgttacctcacgccag

SEQ ID NO: 6907 - DNA, 54 bp, Artificial Sequence
  Synthetic construct
gcgagagcctcaggtggatatagtggctacgaccaatggtactactttgactac

SEQ ID NO: 6908 - DNA, 36 bp, Artificial Sequence
  Synthetic construct
ctgttactggaaggtttgacagcaacttctactgac

SEQ ID NO: 6909 - DNA, 48 bp, Artificial Sequence
  Synthetic construct
gcgagatgcgaaattttgaccggttattatagttgccacttcgactcc

SEQ ID NO: 6910 - DNA, 51 bp, Artificial Sequence
  Synthetic construct
gcgagattgaatggtgactacgaagaggggaactactactacatggacgtc

SEQ ID NO: 6911 - DNA, 36 bp, Artificial Sequence
  Synthetic construct
gcgagtggggttgatacagcctatgcttttgatatc

SEQ ID NO: 6912 - DNA, 54 bp, Artificial Sequence
  Synthetic construct
gtgagagaaagggcccttcggcctaatatagcagctcgtggaccctttgactac

SEQ ID NO: 6913 - DNA, 48 bp, Artificial Sequence
  Synthetic construct
gcgagagataatcagttgaggagcagcacactatggggctttgactac

SEQ ID NO: 6914 - DNA, 36 bp, Artificial Sequence
  Synthetic construct
gcggcggtcagggggagcttctttcaccttcaccac

SEQ ID NO: 6915 - DNA, 51 bp, Artificial Sequence
  Synthetic construct
gtgagagatctctggtcgatctacggtgacttcatcaagggatttgtcgac

SEQ ID NO: 6916 - DNA, 30 bp, Artificial Sequence
  Synthetic construct
gcgagagcatacaattattcttgtggattc

SEQ ID NO: 6917 - DNA, 48 bp, Artificial Sequence
  Synthetic construct
gtgataggccgagcagcaggtggaaggggcactgacgcttttgcgatc

SEQ ID NO: 6918 - DNA, 45 bp, Artificial Sequence
  Synthetic construct
gcaacagatctactatggttcggggagcgtgatgcttttgatatc

SEQ ID NO: 6919 - DNA, 30 bp, Artificial Sequence
  Synthetic construct
gcaacttgggagcagggctggtcggtctac

SEQ ID NO: 6920 - DNA, 57 bp, Artificial Sequence
  Synthetic construct
acgagagttcgacttcgtatagatgcaataggggcccgcagcaactggttcgacccc

SEQ ID NO: 6921 - DNA, 39 bp, Artificial Sequence
  Synthetic construct
gcggcagtctcccaccagtctggtggtgcttttgatatc

SEQ ID NO: 6922 - DNA, 36 bp, Artificial Sequence
  Synthetic construct
gcgagagaccatgggagcgactggtacttcgatctc

SEQ ID NO: 6923 - DNA, 42 bp, Artificial Sequence
  Synthetic construct
gcgagagaaataactgagttttactatggttcgggggactac

SEQ ID NO: 6924 - DNA, 54 bp, Artificial Sequence
  Synthetic construct
gcgagagatcggctctgtagtggtggtagctgctactccgggtggttcgacccc

SEQ ID NO: 6925 - DNA, 48 bp, Artificial Sequence
  Synthetic construct
gcgagagatccaaccccttactatgaggggggttggtacttcgatctc

SEQ ID NO: 6926 - DNA, 42 bp, Artificial Sequence
  Synthetic construct
gcgagaaacctagattactatggtttgggggagttcgacccc

SEQ ID NO: 6927 - DNA, 36 bp, Artificial Sequence
  Synthetic construct
gcaacactggcggttcgaagagtcccacgcccgtac

SEQ ID NO: 6928 - DNA, 36 bp, Artificial Sequence
  Synthetic construct
gtgcgagcgcaccgggggagcccctactttgactcc

SEQ ID NO: 6929 - DNA, 45 bp, Artificial Sequence
  Synthetic construct
gctagagcctctgggggatctacagtccaccgctactatgactac

SEQ ID NO: 6930 - DNA, 45 bp, Artificial Sequence
  Synthetic construct
gttaaagatggagacagcaacaccgcatacttccactttgacact

SEQ ID NO: 6931 - DNA, 57 bp, Artificial Sequence
  Synthetic construct
actagagcctcttactgtattaatggaagatgcacgtcacctggcccctttgacttc

SEQ ID NO: 6932 - DNA, 51 bp, Artificial Sequence
  Synthetic construct
gccagagggggcttccatgacgaataccgggccctttcgccctttgacttc

SEQ ID NO: 6933 - DNA, 60 bp, Artificial Sequence
  Synthetic construct
gcgagagaccgccttcatgacccatccgcggtgcgcttttttgactggtcgtttgacaag

SEQ ID NO: 6934 - DNA, 51 bp, Artificial Sequence
  Synthetic construct
gcgagaatgtcttattacgatggaagtggttactacttcttctttgaccac

SEQ ID NO: 6935 - DNA, 48 bp, Artificial Sequence
  Synthetic construct
gcgacagcgggggcccacagtaatggtttctattacggctttgagtcc

SEQ ID NO: 6936 - DNA, 48 bp, Artificial Sequence
  Synthetic construct
gcgaggttccccataacacctactgctaactattactacatggacgtc

SEQ ID NO: 6937 - DNA, 36 bp, Artificial Sequence
  Synthetic construct
gtgaaatatggtgcacaggaatggttaggggagtct

SEQ ID NO: 6938 - DNA, 54 bp, Artificial Sequence
  Synthetic construct
gcgagagggttcgacgcttatgattttttgcctggctctccctactttgactac

SEQ ID NO: 6939 - DNA, 48 bp, Artificial Sequence
  Synthetic construct
gcgagactagtggagaggttctccccccacactttctactttcactac

SEQ ID NO: 6940 - DNA, 63 bp, Artificial Sequence
  Synthetic construct
gcaagagatcgatctccccttattaagatttttggagtgcttatgggctcctacatggacgtc

SEQ ID NO: 6941 - DNA, 36 bp, Artificial Sequence; identical to SEQ ID NO: 1812
  Synthetic construct

SEQ ID NO: 6942 - DNA, 27 bp, Artificial Sequence
  Synthetic construct
gcgagagtcctatttggggggcccctg

SEQ ID NO: 6943 - DNA, 45 bp, Artificial Sequence
  Synthetic construct
gcgcgcggtctcagtcccaactggtacttcgatgcttttgacata

SEQ ID NO: 6944 - DNA, 30 bp, Artificial Sequence
  Synthetic construct
gcgaaagaatttagaggagcttttgatatc

SEQ ID NO: 6945 - DNA, 48 bp, Artificial Sequence
  Synthetic construct
gcgaggagacacagtggcgacgattcgcccagctacttctttgactac

SEQ ID NO: 6946 - DNA, 45 bp, Artificial Sequence
  Synthetic construct
acgagaggccgatacccccgcatgcttcgcaggcactttgacttc

SEQ ID NO: 6947 - DNA, 48 bp, Artificial Sequence
  Synthetic construct
gcgacccgaagacggatgttttcgaccaatgtcgattcttatgatatc

SEQ ID NO: 6948 - DNA, 45 bp, Artificial Sequence
  Synthetic construct
gcggcagtccctgggggcctcttaattcgcgaaacgttcgagtcg

SEQ ID NO: 6949 - DNA, 39 bp, Artificial Sequence
  Synthetic construct
acaacagcccggggccgctggacctaccactttgcgtcc

SEQ ID NO: 6950 - DNA, 51 bp, Artificial Sequence
  Synthetic construct
gcaagagcggcgatttttggagtggttttttgggaaaactatttcgacccc

SEQ ID NO: 6951 - DNA, 27 bp, Artificial Sequence
  Synthetic construct
gcgagatatgagtatgatcttgactac

SEQ ID NO: 6952 - DNA, 63 bp, Artificial Sequence
  Synthetic construct
gcaacagagggggtcggaaggactaataaagcaggtgttggttgggatgatgcttttgatatc

SEQ ID NO: 6953 - DNA, 60 bp, Artificial Sequence
  Synthetic construct
gcgaaatctaaaacccatactttttatcctggttcgggaggtcccacttacatcgacgac

SEQ ID NO: 6954 - DNA, 48 bp, Artificial Sequence
  Synthetic construct
gcgagagtgatggaaacagccatggcccccgactactacatggacgtc

SEQ ID NO: 6955 - DNA, 51 bp, Artificial Sequence
  Synthetic construct
gcgagcgcgaactggactgcggtgatttcaacaaccgataccctccatgtc

SEQ ID NO: 6956 - DNA, 42 bp, Artificial Sequence
  Synthetic construct
gcgaaggtgctgctgggagctcttaccgatgctttcgatatc

SEQ ID NO: 6957 - DNA, 48 bp, Artificial Sequence; identical to SEQ ID NO: 1815
  Synthetic construct

SEQ ID NO: 6958 - DNA, 66 bp, Artificial Sequence
  Synthetic construct
gcaacctcccctaagtttgatgataacgcctgggggacttttcgtgatacggccacacctgactac

SEQ ID NO: 6959 - DNA, 48 bp, Artificial Sequence
  Synthetic construct
gccagaggcgataggtcgataatagtaggtcaattttacatggacgtc

SEQ ID NO: 6960 - DNA, 45 bp, Artificial Sequence
  Synthetic construct
gcgcgatgtaaggccgaatatacgactggttgccccggggactat

SEQ ID NO: 6961 - DNA, 39 bp, Artificial Sequence
  Synthetic construct
gcgcgacggttttattcttatggttttgcctttgatatc

SEQ ID NO: 6962 - DNA, 57 bp, Artificial Sequence
  Synthetic construct
gcgagaggttggggtatatcgattggtggagcgacaaccaccaagtggctccacccc

SEQ ID NO: 6963 - DNA, 60 bp, Artificial Sequence
  Synthetic construct
gcgagagagggggcaggctattactatgatagcagtggcctgggatatggctttgatatc

SEQ ID NO: 6964 - DNA, 36 bp, Artificial Sequence
  Synthetic construct
gcgagagctgatagcaccgactggcaaatggactac

SEQ ID NO: 6965 - DNA, 33 bp, Artificial Sequence
  Synthetic construct
gcgagacgatatggcttcactcccctcgacttc

SEQ ID NO: 6966 - DNA, 57 bp, Artificial Sequence
  Synthetic construct
gcgagagataatcggccttattatgatatgagtgggtattcacctgaccttgactac

SEQ ID NO: 6967 - DNA, 45 bp, Artificial Sequence
  Synthetic construct
gcgagagagacgtggggattccttggagggggctactttgactat

SEQ ID NO: 6968 - DNA, 42 bp, Artificial Sequence
  Synthetic construct
gcgaaatatcgcccaggacctaagaatgatgctttgcatgtc

SEQ ID NO: 6969 - DNA, 36 bp, Artificial Sequence
  Synthetic construct
gcgcgaatttattatagtgggacgtaccaagactac

SEQ ID NO: 6970 - DNA, 60 bp, Artificial Sequence
  Synthetic construct
actcgagataaaggaatgtatgactggaactccgggacctacctctactacatggacgcc

SEQ ID NO: 6971 - DNA, 51 bp, Artificial Sequence; identical to SEQ ID NO: 1811
  Synthetic construct

SEQ ID NO: 6972 - DNA, 30 bp, Artificial Sequence
  Synthetic construct
accgtccacattggcaccagcgctaacttc

SEQ ID NO: 6973 - DNA, 60 bp, Artificial Sequence
  Synthetic construct
actagagatcgaggaacgtatgactggaactacgggacctacttctactacatggaagtc

SEQ ID NO: 6974 - DNA, 48 bp, Artificial Sequence
  Synthetic construct
gcgagagggggacgcacctttggttatacgtgggagttctttgacaac

SEQ ID NO: 6975 - DNA, 48 bp, Artificial Sequence
  Synthetic construct
gcgagagagagaagtccgagagtcgactactaccactacatggacgtc

SEQ ID NO: 6976 - DNA, 36 bp, Artificial Sequence
  Synthetic construct
gcacacagtccaacatattccaacatctttgacttc

SEQ ID NO: 6977 - DNA, 48 bp, Artificial Sequence
  Synthetic construct
gtaagagcatattgtagtagtagcagctgcccaggcggttttgacttc

SEQ ID NO: 6978 - DNA, 36 bp, Artificial Sequence
  Synthetic construct
gcgaagggccgtgcaaattggcgatactttgacctc

SEQ ID NO: 6979 - DNA, 45 bp, Artificial Sequence
  Synthetic construct
gcgagaattagagtcggggaattatttttcggcacctttgacttc

SEQ ID NO: 6980 - DNA, 57 bp, Artificial Sequence
  Synthetic construct
gcgagaggacgttttcagagagtgggaggcgtctacacctacttctacatggacgtc

SEQ ID NO: 6981 - DNA, 45 bp, Artificial Sequence
  Synthetic construct
gtgaactccttcaaatacaggagcaacccgggggacttcggctcc

SEQ ID NO: 6982 - DNA, 57 bp, Artificial Sequence
  Synthetic construct
gcgagaggttggggtattacgatttctggagcgtctaccagcaagtggctccacccc

SEQ ID NO: 6983 - DNA, 72 bp, Artificial Sequence
  Synthetic construct
gcgagatttggctctccaactctccttattgactacggtgactacgaaaaggtgatcggtgctttggatgtc

SEQ ID NO: 6984 - DNA, 63 bp, Artificial Sequence
  Synthetic construct
gcgagaggtcacagaatatattatgatattagaagttattacggagagtcctggctcgacccc

SEQ ID NO: 6985 - DNA, 36 bp, Artificial Sequence
  Synthetic construct
gcacggatgctggcccgacagaattacttcgacccc

SEQ ID NO: 6986 - DNA, 48 bp, Artificial Sequence
  Synthetic construct
gcacggattctggaccctcattactatggttcgggggctattgactac

SEQ ID NO: 6987 - DNA, 51 bp, Artificial Sequence
  Synthetic construct
tcgacagatgcttccaatgattacacctgggggagttatcgcctagaccac

SEQ ID NO: 6988 - DNA, 57 bp, Artificial Sequence
  Synthetic construct
gcgagagatggtctttattgtagtaggagtggctgtttcgcggactggctcgacctc

SEQ ID NO: 6989 - DNA, 36 bp, Artificial Sequence
  Synthetic construct
gtgagactgactgcggtgactcactactttgactac

SEQ ID NO: 6990 - DNA, 45 bp, Artificial Sequence
  Synthetic construct
gcgaggccccggaggagtggctacaattatgttggttttgatgtc

SEQ ID NO: 6991 - DNA, 42 bp, Artificial Sequence
  Synthetic construct
gcggtggccgcttacccggggagaggtaggcgtctcgacccc

SEQ ID NO: 6992 - DNA, 27 bp, Artificial Sequence
  Synthetic construct
gccagaggagttcgatattacgccccc

SEQ ID NO: 6993 - DNA, 39 bp, Artificial Sequence
  Synthetic construct
actagtccctcggggagttattaccccctcccctactac

SEQ ID NO: 6994 - DNA, 69 bp, Artificial Sequence
  Synthetic construct
gtacgggtaaaatattacgatgttgtgactggccatcctacggcctaccattcctactacatggacgtc

SEQ ID NO: 6995 - DNA, 45 bp, Artificial Sequence
  Synthetic construct
gcacgggcggcgtgtagtggttattactactactacatggacgtc

SEQ ID NO: 6996 - DNA, 51 bp, Artificial Sequence
  Synthetic construct
gcacggatcccacccaacacacagctatgggccaattactactttgactac

SEQ ID NO: 6997 - DNA, 42 bp, Artificial Sequence
  Synthetic construct
gcacggtcatttctgcctacatccagttattcttttgacttc

SEQ ID NO: 6998 - DNA, 66 bp, Artificial Sequence
  Synthetic construct
gcacggacactggttactaatgtggcagcagctgggaattactactaccactactacatggacgtc

SEQ ID NO: 6999 - DNA, 45 bp, Artificial Sequence
  Synthetic construct
gcacggataaggtactatggttcggggagttgttactttgactac

SEQ ID NO: 7000 - DNA, 33 bp, Artificial Sequence
  Synthetic construct
acacggcctgagaggaacgggcagatcgactac

SEQ ID NO: 7001 - DNA, 36 bp, Artificial Sequence
  Synthetic construct
gcacggaattcgaggcgggagagctttttcgacccc

SEQ ID NO: 7002 - DNA, 54 bp, Artificial Sequence
  Synthetic construct
gttagagaggccccttcttactatgatgccagtggttatttctactttgactac

SEQ ID NO: 7003 - DNA, 45 bp, Artificial Sequence
  Synthetic construct
gcacgggaggattttgatagtggaggttatcatgcatttgatatc

SEQ ID NO: 7004 - DNA, 45 bp, Artificial Sequence
  Synthetic construct
gcgaaggatcgtgacatggccacactttggggacacttccaacac

SEQ ID NO: 7005 - DNA, 51 bp, Artificial Sequence
  Synthetic construct
gcacggatgcgggtagtcgggtccggttcggggactcgttactttgactac

SEQ ID NO: 7006 - DNA, 33 bp, Artificial Sequence
  Synthetic construct
gcacaatcctacgtttcggggagtatcaaatcc

SEQ ID NO: 7007 - DNA, 57 bp, Artificial Sequence
  Synthetic construct
gcacacagaattgcgagtcgtaatggcttgaacctctatattgatgcttttgatttt

SEQ ID NO: 7008 - DNA, 48 bp, Artificial Sequence
  Synthetic construct
gcacacagtcgctattactatactttgggttcctggtactttgactac

SEQ ID NO: 7009 - DNA, 27 bp, Artificial Sequence
  Synthetic construct
gcacacaatggcctcccctttgactgc

SEQ ID NO: 7010 - DNA, 54 bp, Artificial Sequence
  Synthetic construct
gcacaccgaggacgatattgtagtggtaccggctgtgggtactactttgactac

SEQ ID NO: 7011 - DNA, 45 bp, Artificial Sequence
  Synthetic construct
gcattcagcccgcgaggtgtttattatgaatatttctttgaccac

SEQ ID NO: 7012 - DNA, 36 bp, Artificial Sequence
  Synthetic construct
gtgtacagtatatatgggtcggggatttttgggtac

SEQ ID NO: 7013 - DNA, 57 bp, Artificial Sequence
  Synthetic construct
gcacacaacgccaaccgtctgtatttctatgatagtggtcccacattctttgactac

SEQ ID NO: 7014 - DNA, 54 bp, Artificial Sequence
  Synthetic construct
acaaaattcgcaacatattactatgatactcctggtcatgaacaccttgactcc

SEQ ID NO: 7015 - DNA, 54 bp, Artificial Sequence
  Synthetic construct
gcgaggacccttataattggaagtacttatgaacctgaatattacatggacgtc

SEQ ID NO: 7016 - DNA, 30 bp, Artificial Sequence
  Synthetic construct
gcgctcttccctagtggcaactacgactac

SEQ ID NO: 7017 - DNA, 75 bp, Artificial Sequence
  Synthetic construct
gcaagagatctctgggtagatattatgagtacgtttgggggacgtatcgccatgacggatggggcttttgatatc

SEQ ID NO: 7018 - DNA, 51 bp, Artificial Sequence
  Synthetic construct
gccagcggatattgtagcggtggaagatgctacggggaattcctccagcac

SEQ ID NO: 7019 - DNA, 60 bp, Artificial Sequence
  Synthetic construct
gcgcgagataaaagggaggtattggttttcagagcaggcactggttcgggattcgacccc

SEQ ID NO: 7020 - DNA, 54 bp, Artificial Sequence
  Synthetic construct
tcgagagggaccaaggggggggtcagcccacactcctactactacgtggacgtc

SEQ ID NO: 7021 - DNA, 36 bp, Artificial Sequence
  Synthetic construct
gcgagagccctgtatgacagcaacccgtttgactac

SEQ ID NO: 7022 - DNA, 42 bp, Artificial Sequence
  Synthetic construct
gcgagagcccgccattattatgggtcggggagttttgactcc

SEQ ID NO: 7023 - DNA, 63 bp, Artificial Sequence
  Synthetic construct
gcgagttcgttaattcggccatattgtgatggtggtgcctgctactcgaattgggtcgacccc

SEQ ID NO: 7024 - DNA, 36 bp, Artificial Sequence
  Synthetic construct
gcgaggtcgagagatggctacaactccctttatatc

SEQ ID NO: 7025 - DNA, 54 bp, Artificial Sequence
  Synthetic construct
gcgagagagtcgaacgagcttcggagtgcttatcacccctatcactttgactac

SEQ ID NO: 7026 - DNA, 51 bp, Artificial Sequence
  Synthetic construct
gcgagagattcccacctggttcggggagtcgagtctcccgaatctgactac

SEQ ID NO: 7027 - DNA, 39 bp, Artificial Sequence
  Synthetic construct
gcgagacagatgggagattattactactatatggacgtc

SEQ ID NO: 7028 - DNA, 36 bp, Artificial Sequence
  Synthetic construct
gcgagatcaatctggcaaccggaatactttgactac

SEQ ID NO: 7029 - DNA, 45 bp, Artificial Sequence
  Synthetic construct
gcggggctgagttattatgacaattttggctctcaaaatgactac

SEQ ID NO: 7030 - DNA, 39 bp, Artificial Sequence
  Synthetic construct
tcgacatcaaagtactacgacaccttacacctctcttcc

SEQ ID NO: 7031 - DNA, 57 bp, Artificial Sequence
  Synthetic construct
gcgagagttattactagggcgagtcctggcacagacgggaggtaccgtatggacgtc

SEQ ID NO: 7032 - DNA, 33 bp, Artificial Sequence
  Synthetic construct
gcgagagagggtccggggcggggccttgactac

SEQ ID NO: 7033 - DNA, 36 bp, Artificial Sequence
  Synthetic construct
gcgagagattccctccagtatagggcttttgatatc

SEQ ID NO: 7034 - DNA, 66 bp, Artificial Sequence
  Synthetic construct
gcgagagggaatttagttcaatattttgactggtcccaagactactactactactacatggacgtc

SEQ ID NO: 7035 - DNA, 48 bp, Artificial Sequence
  Synthetic construct
gcgagagacatgtacaggatctacttctactactactacatggacgtc

SEQ ID NO: 7036 - DNA, 51 bp, Artificial Sequence
  Synthetic construct
gcgagaaatgttggcatttgcagtagtggcagctgccccccgtttgactcc

SEQ ID NO: 7037 - DNA, 60 bp, Artificial Sequence
  Synthetic construct
gcgagagaggggacgtattactatgatagtagtggttattactacaactggttcgacccc

SEQ ID NO: 7038 - DNA, 42 bp, Artificial Sequence
  Synthetic construct
gtgagggaacgtactatggatccgggagtcccctttgactac

SEQ ID NO: 7039 - DNA, 45 bp, Artificial Sequence
  Synthetic construct
gcgagagaggtggataaagctctggtcggagagctttttgactcc

SEQ ID NO: 7040 - DNA, 45 bp, Artificial Sequence
  Synthetic construct
gtgggactgtacttttatgacaacagcggcaccgaaaatgactgt

SEQ ID NO: 7041 - DNA, 45 bp, Artificial Sequence
  Synthetic construct
atgcgacgcgtggtggtgattgatactagggattcttttgacatg

SEQ ID NO: 7042 - DNA, 60 bp, Artificial Sequence
  Synthetic construct
gcgagagccgaggcgtattacgataatttgcccggttattatgcaagtgcgtttgatata

SEQ ID NO: 7043 - DNA, 63 bp, Artificial Sequence
  Synthetic construct
gcggcaacgattttggctaattatgatgtcgtttttgggagtgatcgccgctcctttgacttc

SEQ ID NO: 7044 - DNA, 84 bp, Artificial Sequence
  Synthetic construct
gcgcgcgtggcagcctatcacaatgcttcggggagtttccgtcctagtgggcgctcctactccttcttctactacatggacgtc

SEQ ID NO: 7045 - DNA, 45 bp, Artificial Sequence
  Synthetic construct
gcgagaggccgggggccattgagggggggaagctggttcgactcc

SEQ ID NO: 7046 - DNA, 54 bp, Artificial Sequence
  Synthetic construct
acgagaggccccagaaagtggctacaacaccaatctcgggggggctttgacatc

SEQ ID NO: 7047 - DNA, 48 bp, Artificial Sequence
  Synthetic construct
gcgagaaagggaacttatagcagtggctggtacgatgcttttgatatc

SEQ ID NO: 7048 - DNA, 51 bp, Artificial Sequence
  Synthetic construct
gcgagaggcgcccccaccgttcggggagttattaccaactggttcgacccc

SEQ ID NO: 7049 - DNA, 63 bp, Artificial Sequence
  Synthetic construct
gcgagaggcgtaagatggatggttcggggcggccggtcttactactactactacatggacgtc

SEQ ID NO: 7050 - DNA, 57 bp, Artificial Sequence
  Synthetic construct
gcgagaggctactatagggtgtggaattactatggttcgggcaactacacggacgtc

SEQ ID NO: 7051 - DNA, 54 bp, Artificial Sequence
  Synthetic construct
gcgagaggctgggcccactatagggttcggggagctaagcgttattttgactac

SEQ ID NO: 7052 - DNA, 51 bp, Artificial Sequence
  Synthetic construct
gcgagagggggccggattgtagtagtaccagctgctagctactttgactac

SEQ ID NO: 7053 - DNA, 42 bp, Artificial Sequence
  Synthetic construct
gcgagattatcatttggttcgggggatgatgcttttgatatc

SEQ ID NO: 7054 - DNA, 57 bp, Artificial Sequence
  Synthetic construct
acgagaggccttagagcagtggttggtacttcctacaactactactacatggacgtc

SEQ ID NO: 7055 - DNA, 78 bp, Artificial Sequence
  Synthetic construct
gcgagagtccttggggaggcggaatccgattatttgactggttctcatcttcgttactactactactacatggacgtc

SEQ ID NO: 7056 - DNA, 42 bp, Artificial Sequence
  Synthetic construct
gcgagaggccttgggaagcagtggttcagctgcttcgacccc

SEQ ID NO: 7057 - DNA, 33 bp, Artificial Sequence
  Synthetic construct
gcgagagttactaacagaggctggtatagggcc

SEQ ID NO: 7058 - DNA, 66 bp, Artificial Sequence
  Synthetic construct
gcgagagggggagcctattccgatttttggagtggctttccaaatgcccgagccttctttgactcc

SEQ ID NO: 7059 - DNA, 60 bp, Artificial Sequence
  Synthetic construct
tcgagaggaaatgccgggatagccggtcatatttttcacttcctctactacatcgacgtc

SEQ ID NO: 7060 - DNA, 39 bp, Artificial Sequence
  Synthetic construct
gcgagagatggcccgggaaagaactacttcttggacgtc

SEQ ID NO: 7061 - DNA, 42 bp, Artificial Sequence
  Synthetic construct
gccagagtctacaatggagatggcaacaaccccattgactac

SEQ ID NO: 7062 - DNA, 60 bp, Artificial Sequence
  Synthetic construct
gccagagggtccctggatgatgatagtagtggttattactcctactactatatggacgtc

SEQ ID NO: 7063 - DNA, 45 bp, Artificial Sequence
  Synthetic construct
gccagagccaagggagatggctacattgggggcatttttgactcc

SEQ ID NO: 7064 - DNA, 51 bp, Artificial Sequence
  Synthetic construct
gcgagactgaattactatgatcgtaatggtcattactattactttgactac

SEQ ID NO: 7065 - DNA, 45 bp, Artificial Sequence
  Synthetic construct
gcgagaaacttcggtgactacgcctacccctacttctttgacttc

SEQ ID NO: 7066 - DNA, 48 bp, Artificial Sequence
  Synthetic construct
gcgagaggtattattttgagtgggtcccccctctactacctggacgtc

SEQ ID NO: 7067 - DNA, 36 bp, Artificial Sequence
  Synthetic construct
gcgagattcgcccgactagactactacatggacgtc

SEQ ID NO: 7068 - DNA, 63 bp, Artificial Sequence
  Synthetic construct
gcccgactttactggggttgtactaatggtgtatgctcctactactactactacatggacgtc

SEQ ID NO: 7069 - DNA, 57 bp, Artificial Sequence
  Synthetic construct
gcgagaatcccgaccccgaatgtgggatatacagctgggtactactacatggacgtc

SEQ ID NO: 7070 - DNA, 39 bp, Artificial Sequence
  Synthetic construct
gcgagagaaaggcatgactacgtaggagcttttgatatc

SEQ ID NO: 7071 - DNA, 54 bp, Artificial Sequence
  Synthetic construct
gcgagagaaggaagcagcagctggtacacgacctggggatgggcttttgatatc

SEQ ID NO: 7072 - DNA, 39 bp, Artificial Sequence
  Synthetic construct
gcgagagataatcagattactaaggatgcttttgatatc

SEQ ID NO: 7073 - DNA, 51 bp, Artificial Sequence
  Synthetic construct
gcgagagatcggagctatagtggctactactactactactacatggacgtc

SEQ ID NO: 7074 - DNA, 30 bp, Artificial Sequence
  Synthetic construct
gcgagcggtattggtgactactttgactac

SEQ ID NO: 7075 - DNA, 54 bp, Artificial Sequence
  Synthetic construct
gcgagacgacattcggagcagtggctgttaaggggccctggtgcttttgatatc

SEQ ID NO: 7076 - DNA, 42 bp, Artificial Sequence
  Synthetic construct
gcgagagggtcggaatggcgtctctattactactttgactac

SEQ ID NO: 7077 - DNA, 45 bp, Artificial Sequence
  Synthetic construct
gcgagacgggtggtggtagatcctactctcgggtcatttgatatc

SEQ ID NO: 7078 - DNA, 30 bp, Artificial Sequence
  Synthetic construct
gcgagagatcgcaggggatacagcttttac

SEQ ID NO: 7079 - DNA, 57 bp, Artificial Sequence
  Synthetic construct
gcgagagagttttattactctgatagtaatgattttccatttcatgtttttgatatc

SEQ ID NO: 7080 - DNA, 33 bp, Artificial Sequence
  Synthetic construct
gcgagagagggtataggcggagctactgatatc

SEQ ID NO: 7081 - DNA, 51 bp, Artificial Sequence
  Synthetic construct
gcgagagatctcggctacggtggtaactccccccactggtacttcgatctc

SEQ ID NO: 7082 - DNA, 42 bp, Artificial Sequence
  Synthetic construct
gcgagagcggactacggtgactacgaggactactttgactac

SEQ ID NO: 7083 - DNA, 33 bp, Artificial Sequence
  Synthetic construct
gcgagaggcggcggaggggggtggttcgacccc

SEQ ID NO: 7084 - DNA, 48 bp, Artificial Sequence
  Synthetic construct
gcgagagggggactctatggttcggggagagtaaactggttcgacccc

SEQ ID NO: 7085 - DNA, 36 bp, Artificial Sequence
  Synthetic construct
gcgagatcccgttcgaggcagcagccaaatgactac

SEQ ID NO: 7086 - DNA, 42 bp, Artificial Sequence
  Synthetic construct
gcgagagatcgtaagggtagtgacggtgatagcatggacgtc

SEQ ID NO: 7087 - DNA, 57 bp, Artificial Sequence
  Synthetic construct
gcgagggcccgacaccgatactacgattctttgactggccaggggtcctttgattac

SEQ ID NO: 7088 - DNA, 36 bp, Artificial Sequence
  Synthetic construct
gtgagagggggagatatagagactaccatggagttc

SEQ ID NO: 7089 - DNA, 48 bp, Artificial Sequence
  Synthetic construct
gcgcgaaatgggcctaagtggaacaattactactactacatggacgtc

SEQ ID NO: 7090 - DNA, 42 bp, Artificial Sequence
  Synthetic construct
gtgaggacccttagagatggcttcaattcctggttcgacccc

SEQ ID NO: 7091 - DNA, 45 bp, Artificial Sequence
  Synthetic construct
gcgagaggcccacccatagacgactactactactacatggacgtc

SEQ ID NO: 7092 - DNA, 63 bp, Artificial Sequence
  Synthetic construct
actagacatctgatgaattttgatttctggagtggctattatacggtgaacgcttttgatatc

SEQ ID NO: 7093 - DNA, 45 bp, Artificial Sequence
  Synthetic construct
gcgagaaggacatatgctgttaacggtgattactactttgactcc

SEQ ID NO: 7094 - DNA, 63 bp, Artificial Sequence
  Synthetic construct
gcgcgaggccttttttattttgggtcggggacttatgcacgagatccacggagttgggggtac

SEQ ID NO: 7095 - DNA, 60 bp, Artificial Sequence
  Synthetic construct
gcgagaggggaggcgatagtattgtttggggagctgttaaaacgcccttatatggatgtc

SEQ ID NO: 7096 - DNA, 48 bp, Artificial Sequence
  Synthetic construct
gcgagaggctcagcacgtctagcagcaggaagaagtgcttttgatttc

SEQ ID NO: 7097 - DNA, 51 bp, Artificial Sequence
  Synthetic construct
gcgaggacccccccatatagtggctacgattacgaaggctactttgactac

SEQ ID NO: 7098 - DNA, 45 bp, Artificial Sequence
  Synthetic construct
gcgagaggggactggtttcagggtagtggccttccttttgactcc

SEQ ID NO: 7099 - DNA, 36 bp, Artificial Sequence
  Synthetic construct
gccagggctgggaggggcccaagtgtctttgactac

SEQ ID NO: 7100 - DNA, 45 bp, Artificial Sequence
  Synthetic construct
gcgacgtatgattcggggagttattaccaatctcccttagacttc

SEQ ID NO: 7101 - DNA, 42 bp, Artificial Sequence
  Synthetic construct
gcgagacattcagattggatacagttgtggttctttgacttc

SEQ ID NO: 7102 - DNA, 84 bp, Artificial Sequence
  Synthetic construct
gcgcgagtggcagcgtatcacaatgcttcggggagtttccgtcctagtgggcgctcctactccttcttctactacatggacgtc

SEQ ID NO: 7103 - DNA, 42 bp, Artificial Sequence
  Synthetic construct
gcgagaatgggggcatatggcagtggcttttatgggggatac

SEQ ID NO: 7104 - DNA, 18 bp, Artificial Sequence
  Synthetic construct
acgagaagtgatagacac

SEQ ID NO: 7105 - DNA, 54 bp, Artificial Sequence
  Synthetic construct
gcgagacacggaggaagtacaccccactatattcgagtgaactggttcggcccc

SEQ ID NO: 7106 - DNA, 42 bp, Artificial Sequence
  Synthetic construct
gcgagacaaacttcgcttgggggagttatcgcttttgacatc

SEQ ID NO: 7107 - DNA, 69 bp, Artificial Sequence
  Synthetic construct
gcgacccatcctcgtgggacatttgagggagcccatgactattactactactactactacatggacgtc

SEQ ID NO: 7108 - DNA, 39 bp, Artificial Sequence
  Synthetic construct
gcgagacacccctacggtggtaactccgggcaggactac

SEQ ID NO: 7109 - DNA, 54 bp, Artificial Sequence
  Synthetic construct
gcgagatcaattcctttggaatatagtagtcaaacggggggtttgttcgacccc

SEQ ID NO: 7110 - DNA, 63 bp, Artificial Sequence
  Synthetic construct
gcgagacggccgcccggcgattgtactaatggtgtatgctccacgcaaaggtggttcgacccc

SEQ ID NO: 7111 - DNA, 48 bp, Artificial Sequence
  Synthetic construct
gcgagagctagcagctcgtccaaatactactactactacatggacgtc

SEQ ID NO: 7112 - DNA, 42 bp, Artificial Sequence
  Synthetic construct
gcgagacggggagtgggagctacgaggaaggcttttgatatc

SEQ ID NO: 7113 - DNA, 51 bp, Artificial Sequence
  Synthetic construct
gtgagacacgactacagtagcttttactactactactacttcatggacgtc

SEQ ID NO: 7114 - DNA, 30 bp, Artificial Sequence
  Synthetic construct
gcgagcgcattagcagctggtaaatactac

SEQ ID NO: 7115 - DNA, 39 bp, Artificial Sequence
  Synthetic construct
gcgagactcttaagcctgaggaatgcggcttttgatatc

SEQ ID NO: 7116 - DNA, 48 bp, Artificial Sequence
  Synthetic construct
gcgagagattatattgatgtaacccacggctacagttgtttcgacccc

SEQ ID NO: 7117 - DNA, 57 bp, Artificial Sequence
  Synthetic construct
gcgagagactttgatcaaggatattattcttcggggagttattcctggttcgacgcc

SEQ ID NO: 7118 - DNA, 45 bp, Artificial Sequence
  Synthetic construct
gtgagagggggccgggcaactttgaccaacgcggactttgactac

SEQ ID NO: 7119 - DNA, 45 bp, Artificial Sequence
  Synthetic construct
gcgagaacatatagtagtggttattatagtgatgcttttgatatc

SEQ ID NO: 7120 - DNA, 45 bp, Artificial Sequence
  Synthetic construct
gtgagaaccccagcgttaggggagttagttggatacttccagccc

SEQ ID NO: 7121 - DNA, 57 bp, Artificial Sequence
  Synthetic construct
gcgagagacgcatataattactatgcttcgaggagccgatacggttactttgactac

SEQ ID NO: 7122 - DNA, 57 bp, Artificial Sequence
  Synthetic construct
gcgcgagacgggacgccggctgagcgacggtcctactcctactcctacatggacgtc

SEQ ID NO: 7123 - DNA, 36 bp, Artificial Sequence
  Synthetic construct
gcgagaggggagtatctcggctactacatggacgtc

SEQ ID NO: 7124 - DNA, 63 bp, Artificial Sequence
  Synthetic construct
gcgagaatgccgaatcttatggatacagctatggtttcctactactactactacatggacgtc

SEQ ID NO: 7125 - DNA, 42 bp, Artificial Sequence
  Synthetic construct
gcgagaggggatgatagtagtggttatgccccctttgactac

SEQ ID NO: 7126 - DNA, 39 bp, Artificial Sequence
  Synthetic construct
gcgagagtcaatactatggttcggggaacttttgactac

SEQ ID NO: 7127 - DNA, 60 bp, Artificial Sequence
  Synthetic construct
gcgtcaacgtattactatgatagtagtgggggaagacgggttcctgttgcttttgaaatc

SEQ ID NO: 7128 - DNA, 51 bp, Artificial Sequence
  Synthetic construct
gcgtcgaggggttcggggagttattataaagggggttactactttgactac

SEQ ID NO: 7129 - DNA, 57 bp, Artificial Sequence
  Synthetic construct
gcgagagcgatggattactctgatagtagtggtgattattactattacttcgatctc

SEQ ID NO: 7130 - DNA, 48 bp, Artificial Sequence
  Synthetic construct
gtgagagagagctcttatggttcggggactagcaaatacttcgacccc

SEQ ID NO: 7131 - DNA, 39 bp, Artificial Sequence
  Synthetic construct
gtgagacgctggtacggtgactaccccgcctttgactac

SEQ ID NO: 7132 - DNA, 48 bp, Artificial Sequence
  Synthetic construct
gcgagagtcttgtgtagtggtcgtaagtgccaaggggatttcgactac

SEQ ID NO: 7133 - DNA, 54 bp, Artificial Sequence
  Synthetic construct
gcgagacttatggagtcttctgaccccgctaattacttctcctacatggacgtc

SEQ ID NO: 7134 - DNA, 51 bp, Artificial Sequence
  Synthetic construct
gcgaccctgagttcttattatgatattttgactggtttggcctcggacgtc

SEQ ID NO: 7135 - DNA, 42 bp, Artificial Sequence
  Synthetic construct
gcggggagacgctcggggaggggtgattactactttgaattg

SEQ ID NO: 7136 - DNA, 42 bp, Artificial Sequence
  Synthetic construct
gcgagagaaggttactatgatggtagtggttattacactcac

SEQ ID NO: 7137 - DNA, 33 bp, Artificial Sequence
  Synthetic construct
gcgagagtgggcattgcagcaggtgtcgacgtc

SEQ ID NO: 7138 - DNA, 66 bp, Artificial Sequence
  Synthetic construct
gcgagagagagggcggattacgatctttttactggttatccctcacgcccagatgcttttgaaatc

SEQ ID NO: 7139 - DNA, 54 bp, Artificial Sequence
  Synthetic construct
gcgagacgcctggggtgggaacagggcggccgtcactcctactacatggacgtc

SEQ ID NO: 7140 - DNA, 48 bp, Artificial Sequence
  Synthetic construct
gccagagatgggggctacgatgcagtcttattctactacctgggcgtc

SEQ ID NO: 7141 - DNA, 36 bp, Artificial Sequence
  Synthetic construct
gggaggatccatgatagtggttggttcgttctttat

SEQ ID NO: 7142 - DNA, 45 bp, Artificial Sequence
  Synthetic construct
gcgaggcacccgcggaagttcggggagttattgggatttgactcc

SEQ ID NO: 7143 - DNA, 48 bp, Artificial Sequence
  Synthetic construct
gcggcggagggaggtgattgtcttaatggtgtgtgctataaagtctcc

SEQ ID NO: 7144 - DNA, 33 bp, Artificial Sequence
  Synthetic construct
gcgagaggtctgtcctcagtggctggcacgggg

SEQ ID NO: 7145 - DNA, 45 bp, Artificial Sequence
  Synthetic construct
gcatcagcagagcagtggcccacggagcacgacgcttttgatatc

SEQ ID NO: 7146 - DNA, 60 bp, Artificial Sequence; identical to SEQ ID NO: 1816
  Synthetic construct

SEQ ID NO: 7147 - DNA, 51 bp, Artificial Sequence
  Synthetic construct
gcgagaggaggcggtgggttcagtcatggccgcctcaaggctcttgatgtc

SEQ ID NO: 7148 - DNA, 48 bp, Artificial Sequence
  Synthetic construct
gcgagagtcggcctgttgcagcaggtggcccatgatgctttggatatc

SEQ ID NO: 7149 - DNA, 45 bp, Artificial Sequence
  Synthetic construct
gcgagaccttgtagtggtgctaactgcttcaacacggcgggtctc

SEQ ID NO: 7150 - DNA, 51 bp, Artificial Sequence
  Synthetic construct
acgagaggccggctgattttcagcagcagccggtacgatgcttttgatatc

SEQ ID NO: 7151 - DNA, 45 bp, Artificial Sequence
  Synthetic construct
gcgagagatatggggcgtattggaagtagcaccgaatttgactgc

SEQ ID NO: 7152 - DNA, 39 bp, Artificial Sequence
  Synthetic construct
gcaacagatcggcgagtggaaactctctactttcacttc

SEQ ID NO: 7153 - DNA, 45 bp, Artificial Sequence
  Synthetic construct
gtacgcgactatgattacgttgggggcagttatcgtcttgaccgg

SEQ ID NO: 7154 - DNA, 45 bp, Artificial Sequence
  Synthetic construct
gcgagacttctcaaggggtccagttggtacaatggtcttgacatc

SEQ ID NO: 7155 - DNA, 42 bp, Artificial Sequence
  Synthetic construct
gcgaaacggtataatactacccacctttggtactttgactcc

SEQ ID NO: 7156 - DNA, 66 bp, Artificial Sequence; identical to SEQ ID NO: 3259
  Synthetic construct

SEQ ID NO: 7157 - DNA, 54 bp, Artificial Sequence; identical to SEQ ID NO: 3260
  Synthetic construct

SEQ ID NO: 7158 - DNA, 57 bp, Artificial Sequence; identical to SEQ ID NO: 3261
  Synthetic construct

SEQ ID NO: 7159 - DNA, 63 bp, Artificial Sequence; identical to SEQ ID NO: 3262
  Synthetic construct

SEQ ID NO: 7160 - DNA, 81 bp, Artificial Sequence
  Synthetic construct
tgcgcgcggggccacagtagctcgtctcaacggtctagcttcgacggtaactttttatactactactatcaccaaatggac

SEQ ID NO: 7161 - DNA, 69 bp, Artificial Sequence; identical to SEQ ID NO: 3264
  Synthetic construct

SEQ ID NO: 7162 - DNA, 54 bp, Artificial Sequence; identical to SEQ ID NO: 3265
  Synthetic construct

SEQ ID NO: 7163 - DNA, 54 bp, Artificial Sequence; identical to SEQ ID NO: 3266
  Synthetic construct

SEQ ID NO: 7164 - DNA, 66 bp, Artificial Sequence; identical to SEQ ID NO: 3267
  Synthetic construct

SEQ ID NO: 7165 - DNA, 39 bp, Artificial Sequence; identical to SEQ ID NO: 3268
  Synthetic construct

SEQ ID NO: 7166 - DNA, 57 bp, Artificial Sequence; identical to SEQ ID NO: 3269
  Synthetic construct

SEQ ID NO: 7167 - DNA, 39 bp, Artificial Sequence; identical to SEQ ID NO: 3270
  Synthetic construct

SEQ ID NO: 7168 - DNA, 45 bp, Artificial Sequence; identical to SEQ ID NO: 3271
  Synthetic construct

SEQ ID NO: 7169 - DNA, 36 bp, Artificial Sequence; identical to SEQ ID NO: 3272
  Synthetic construct

SEQ ID NO: 7170 - DNA, 45 bp, Artificial Sequence; identical to SEQ ID NO: 3273
  Synthetic construct

SEQ ID NO: 7171 - DNA, 54 bp, Artificial Sequence; identical to SEQ ID NO: 3274
  Synthetic construct

SEQ ID NO: 7172 - DNA, 69 bp, Artificial Sequence; identical to SEQ ID NO: 3275
  Synthetic construct

SEQ ID NO: 7173 - DNA, 54 bp, Artificial Sequence; identical to SEQ ID NO: 3276
  Synthetic construct

SEQ ID NO: 7174 - DNA, 45 bp, Artificial Sequence; identical to SEQ ID NO: 3277
  Synthetic construct

SEQ ID NO: 7175 - DNA, 45 bp, Artificial Sequence; identical to SEQ ID NO: 3278
  Synthetic construct

SEQ ID NO: 7176 - DNA, 57 bp, Artificial Sequence; identical to SEQ ID NO: 3279
  Synthetic construct

SEQ ID NO: 7177 - DNA, 45 bp, Artificial Sequence; identical to SEQ ID NO: 3280
  Synthetic construct

SEQ ID NO: 7178 - DNA, 48 bp, Artificial Sequence; identical to SEQ ID NO: 3281
  Synthetic construct

SEQ ID NO: 7179 - DNA, 48 bp, Artificial Sequence; identical to SEQ ID NO: 3282
  Synthetic construct

SEQ ID NO: 7180 - DNA, 36 bp, Artificial Sequence; identical to SEQ ID NO: 3283
  Synthetic construct

SEQ ID NO: 7181 - DNA, 60 bp, Artificial Sequence; identical to SEQ ID NO: 3284
  Synthetic construct

SEQ ID NO: 7182 - DNA, 66 bp, Artificial Sequence; identical to SEQ ID NO: 3285
  Synthetic construct

SEQ ID NO: 7183 - DNA, 75 bp, Artificial Sequence; identical to SEQ ID NO: 3286
  Synthetic construct

SEQ ID NO: 7184 - DNA, 45 bp, Artificial Sequence; identical to SEQ ID NO: 3287
  Synthetic construct

SEQ ID NO: 7185 - DNA, 51 bp, Artificial Sequence; identical to SEQ ID NO: 3288
  Synthetic construct

SEQ ID NO: 7186 - DNA, 39 bp, Artificial Sequence; identical to SEQ ID NO: 3289
  Synthetic construct

SEQ ID NO: 7187 - DNA, 54 bp, Artificial Sequence; identical to SEQ ID NO: 3290
  Synthetic construct

SEQ ID NO: 7188 - DNA, 57 bp, Artificial Sequence; identical to SEQ ID NO: 3291
  Synthetic construct

SEQ ID NO: 7189 - DNA, 75 bp, Artificial Sequence; identical to SEQ ID NO: 3292
  Synthetic construct

SEQ ID NO: 7190 - DNA, 69 bp, Artificial Sequence; identical to SEQ ID NO: 3293
  Synthetic construct

SEQ ID NO: 7191 - DNA, 45 bp, Artificial Sequence; identical to SEQ ID NO: 3294
  Synthetic construct

SEQ ID NO: 7192 - DNA, 42 bp, Artificial Sequence; identical to SEQ ID NO: 3295
  Synthetic construct

SEQ ID NO: 7193 - DNA, 57 bp, Artificial Sequence; identical to SEQ ID NO: 3296
  Synthetic construct

SEQ ID NO: 7194 - DNA, 51 bp, Artificial Sequence; identical to SEQ ID NO: 3297
  Synthetic construct

SEQ ID NO: 7195 - DNA, 42 bp, Artificial Sequence; identical to SEQ ID NO: 3298
  Synthetic construct

SEQ ID NO: 7196 - DNA, 60 bp, Artificial Sequence; identical to SEQ ID NO: 3299
  Synthetic construct

SEQ ID NO: 7197 - DNA, 57 bp, Artificial Sequence; identical to SEQ ID NO: 3300
  Synthetic construct

SEQ ID NO: 7198 - DNA, 69 bp, Artificial Sequence; identical to SEQ ID NO: 3301
  Synthetic construct

SEQ ID NO: 7199 - DNA, 48 bp, Artificial Sequence; identical to SEQ ID NO: 3302
  Synthetic construct

SEQ ID NO: 7200 - DNA, 54 bp, Artificial Sequence; identical to SEQ ID NO: 1772
  Synthetic construct

SEQ ID NO: 7201 - DNA, 60 bp, Artificial Sequence; identical to SEQ ID NO: 3304
  Synthetic construct

SEQ ID NO: 7202 - DNA, 36 bp, Artificial Sequence; identical to SEQ ID NO: 3305
  Synthetic construct

SEQ ID NO: 7203 - DNA, 51 bp, Artificial Sequence; identical to SEQ ID NO: 3306
  Synthetic construct

SEQ ID NO: 7204 - DNA, 69 bp, Artificial Sequence; identical to SEQ ID NO: 3307
  Synthetic construct

SEQ ID NO: 7205 - DNA, 36 bp, Artificial Sequence; identical to SEQ ID NO: 3308
  Synthetic construct

SEQ ID NO: 7206 - DNA, 75 bp, Artificial Sequence; identical to SEQ ID NO: 3309
  Synthetic construct

SEQ ID NO: 7207 - DNA, 51 bp, Artificial Sequence; identical to SEQ ID NO: 3310
  Synthetic construct

SEQ ID NO: 7208 - DNA, 66 bp, Artificial Sequence; identical to SEQ ID NO: 3311
  Synthetic construct

SEQ ID NO: 7209 - DNA, 57 bp, Artificial Sequence; identical to SEQ ID NO: 3312
  Synthetic construct

SEQ ID NO: 7210 - DNA, 54 bp, Artificial Sequence; identical to SEQ ID NO: 3313
  Synthetic construct

SEQ ID NO: 7211 - DNA, 60 bp, Artificial Sequence; identical to SEQ ID NO: 3314
  Synthetic construct

SEQ ID NO: 7212 - DNA, 60 bp, Artificial Sequence; identical to SEQ ID NO: 3315
  Synthetic construct

SEQ ID NO: 7213 - DNA, 57 bp, Artificial Sequence; identical to SEQ ID NO: 3316
  Synthetic construct

SEQ ID NO: 7214 - DNA, 57 bp, Artificial Sequence; identical to SEQ ID NO: 3317
  Synthetic construct

SEQ ID NO: 7215 - DNA, 30 bp, Artificial Sequence; identical to SEQ ID NO: 3318
  Synthetic construct

SEQ ID NO: 7216 - DNA, 75 bp, Artificial Sequence; identical to SEQ ID NO: 3319
  Synthetic construct

SEQ ID NO: 7217 - DNA, 66 bp, Artificial Sequence; identical to SEQ ID NO: 3320
  Synthetic construct

SEQ ID NO: 7218 - DNA, 60 bp, Artificial Sequence; identical to SEQ ID NO: 3321
  Synthetic construct

SEQ ID NO: 7219 - DNA, 63 bp, Artificial Sequence; identical to SEQ ID NO: 3322
  Synthetic construct

SEQ ID NO: 7220 - DNA, 57 bp, Artificial Sequence; identical to SEQ ID NO: 3323
  Synthetic construct

SEQ ID NO: 7221 - DNA, 78 bp, Artificial Sequence; identical to SEQ ID NO: 3324
  Synthetic construct

SEQ ID NO: 7222 - DNA, 60 bp, Artificial Sequence; identical to SEQ ID NO: 3325
  Synthetic construct

SEQ ID NO: 7223 - DNA, 51 bp, Artificial Sequence; identical to SEQ ID NO: 3326
  Synthetic construct

SEQ ID NO: 7224 - DNA, 39 bp, Artificial Sequence; identical to SEQ ID NO: 3327
  Synthetic construct

SEQ ID NO: 7225 - DNA, 57 bp, Artificial Sequence; identical to SEQ ID NO: 3328
  Synthetic construct

SEQ ID NO: 7226 - DNA, 39 bp, Artificial Sequence; identical to SEQ ID NO: 3329
  Synthetic construct

SEQ ID NO: 7227 - DNA, 45 bp, Artificial Sequence; identical to SEQ ID NO: 3330
  Synthetic construct

SEQ ID NO: 7228 - DNA, 75 bp, Artificial Sequence; identical to SEQ ID NO: 3331
  Synthetic construct

SEQ ID NO: 7229 - DNA, 66 bp, Artificial Sequence; identical to SEQ ID NO: 3332
  Synthetic construct

SEQ ID NO: 7230 - DNA, 42 bp, Artificial Sequence; identical to SEQ ID NO: 3333
  Synthetic construct

SEQ ID NO: 7231 - DNA, 72 bp, Artificial Sequence; identical to SEQ ID NO: 3334
  Synthetic construct

SEQ ID NO: 7232 - DNA, 45 bp, Artificial Sequence; identical to SEQ ID NO: 3335
  Synthetic construct

SEQ ID NO: 7233 - DNA, 42 bp, Artificial Sequence; identical to SEQ ID NO: 3336
  Synthetic construct

SEQ ID NO: 7234 - DNA, 33 bp, Artificial Sequence; identical to SEQ ID NO: 3337
  Synthetic construct

SEQ ID NO: 7235 - DNA, 48 bp, Artificial Sequence; identical to SEQ ID NO: 3338
  Synthetic construct

SEQ ID NO: 7236 - DNA, 54 bp, Artificial Sequence; identical to SEQ ID NO: 3339
  Synthetic construct

SEQ ID NO: 7237 - DNA, 60 bp, Artificial Sequence; identical to SEQ ID NO: 3340
  Synthetic construct

SEQ ID NO: 7238 - DNA, 48 bp, Artificial Sequence; identical to SEQ ID NO: 3341
  Synthetic construct

SEQ ID NO: 7239 - DNA, 60 bp, Artificial Sequence; identical to SEQ ID NO: 3342
  Synthetic construct

SEQ ID NO: 7240 - DNA, 51 bp, Artificial Sequence; identical to SEQ ID NO: 3343
  Synthetic construct

SEQ ID NO: 7241 - DNA, 69 bp, Artificial Sequence; identical to SEQ ID NO: 3344
  Synthetic construct

SEQ ID NO: 7242 - DNA, 48 bp, Artificial Sequence; identical to SEQ ID NO: 3345
  Synthetic construct

SEQ ID NO: 7243 - DNA, 54 bp, Artificial Sequence; identical to SEQ ID NO: 3346
  Synthetic construct

SEQ ID NO: 7244 - DNA, 42 bp, Artificial Sequence; identical to SEQ ID NO: 3347
  Synthetic construct

SEQ ID NO: 7245 - DNA, 33 bp, Artificial Sequence; identical to SEQ ID NO: 3348
  Synthetic construct

SEQ ID NO: 7246 - DNA, 51 bp, Artificial Sequence; identical to SEQ ID NO: 3349
  Synthetic construct

SEQ ID NO: 7247 - DNA, 69 bp, Artificial Sequence; identical to SEQ ID NO: 3350
  Synthetic construct

SEQ ID NO: 7248 - DNA, 54 bp, Artificial Sequence; identical to SEQ ID NO: 3351
  Synthetic construct

SEQ ID NO: 7249 - DNA, 51 bp, Artificial Sequence; identical to SEQ ID NO: 3352
  Synthetic construct

SEQ ID NO: 7250 - DNA, 60 bp, Artificial Sequence; identical to SEQ ID NO: 3353
  Synthetic construct

SEQ ID NO: 7251 - DNA, 60 bp, Artificial Sequence; identical to SEQ ID NO: 3354
  Synthetic construct

SEQ ID NO: 7252 - DNA, 51 bp, Artificial Sequence; identical to SEQ ID NO: 3355
  Synthetic construct

SEQ ID NO: 7253 - DNA, 48 bp, Artificial Sequence; identical to SEQ ID NO: 3356
  Synthetic construct

SEQ ID NO: 7254 - DNA, 39 bp, Artificial Sequence; identical to SEQ ID NO: 3357
  Synthetic construct

SEQ ID NO: 7255 - DNA, 57 bp, Artificial Sequence; identical to SEQ ID NO: 3358
  Synthetic construct

SEQ ID NO: 7256 - DNA, 54 bp, Artificial Sequence; identical to SEQ ID NO: 3359
  Synthetic construct

SEQ ID NO: 7257 - DNA, 60 bp, Artificial Sequence; identical to SEQ ID NO: 3360
  Synthetic construct

SEQ ID NO: 7258 - DNA, 45 bp, Artificial Sequence; identical to SEQ ID NO: 3361
  Synthetic construct

SEQ ID NO: 7259 - DNA, 51 bp, Artificial Sequence; identical to SEQ ID NO: 3362
  Synthetic construct

SEQ ID NO: 7260 - DNA, 51 bp, Artificial Sequence; identical to SEQ ID NO: 3363
  Synthetic construct

SEQ ID NO: 7261 - DNA, 69 bp, Artificial Sequence; identical to SEQ ID NO: 3364
  Synthetic construct

SEQ ID NO: 7262 - DNA, 54 bp, Artificial Sequence; identical to SEQ ID NO: 3365
  Synthetic construct

SEQ ID NO: 7263 - DNA, 42 bp, Artificial Sequence; identical to SEQ ID NO: 3366
  Synthetic construct

SEQ ID NO: 7264 - DNA, 81 bp, Artificial Sequence; identical to SEQ ID NO: 3367
  Synthetic construct

SEQ ID NO: 7265 - DNA, 48 bp, Artificial Sequence; identical to SEQ ID NO: 3368
  Synthetic construct

SEQ ID NO: 7266 - DNA, 51 bp, Artificial Sequence; identical to SEQ ID NO: 3369
  Synthetic construct

SEQ ID NO: 7267 - DNA, 51 bp, Artificial Sequence; identical to SEQ ID NO: 3370
  Synthetic construct

SEQ ID NO: 7268 - DNA, 57 bp, Artificial Sequence; identical to SEQ ID NO: 3371
  Synthetic construct

SEQ ID NO: 7269 - DNA, 51 bp, Artificial Sequence; identical to SEQ ID NO: 3372
  Synthetic construct

SEQ ID NO: 7270 - DNA, 51 bp, Artificial Sequence; identical to SEQ ID NO: 3373
  Synthetic construct

SEQ ID NO: 7271 - DNA, 42 bp, Artificial Sequence; identical to SEQ ID NO: 3374
  Synthetic construct

SEQ ID NO: 7272 - DNA, 57 bp, Artificial Sequence; identical to SEQ ID NO: 3375
  Synthetic construct

SEQ ID NO: 7273 - DNA, 57 bp, Artificial Sequence; identical to SEQ ID NO: 3376
  Synthetic construct

SEQ ID NO: 7274 - DNA, 54 bp, Artificial Sequence; identical to SEQ ID NO: 3377
  Synthetic construct

SEQ ID NO: 7275 - DNA, 42 bp, Artificial Sequence; identical to SEQ ID NO: 3378
  Synthetic construct

SEQ ID NO: 7276 - DNA, 33 bp, Artificial Sequence; identical to SEQ ID NO: 3379
  Synthetic construct

SEQ ID NO: 7277 - DNA, 72 bp, Artificial Sequence; identical to SEQ ID NO: 3380
  Synthetic construct

SEQ ID NO: 7278 - DNA, 60 bp, Artificial Sequence; identical to SEQ ID NO: 3381
  Synthetic construct

SEQ ID NO: 7279 - DNA, 42 bp, Artificial Sequence; identical to SEQ ID NO: 3382
  Synthetic construct

SEQ ID NO: 7280 - DNA, 42 bp, Artificial Sequence; identical to SEQ ID NO: 3383
  Synthetic construct

SEQ ID NO: 7281 - DNA, 54 bp, Artificial Sequence; identical to SEQ ID NO: 3384
  Synthetic construct

SEQ ID NO: 7282 - DNA, 60 bp, Artificial Sequence; identical to SEQ ID NO: 3385
  Synthetic construct

SEQ ID NO: 7283 - DNA, 54 bp, Artificial Sequence; identical to SEQ ID NO: 3386
  Synthetic construct

SEQ ID NO: 7284 - DNA, 75 bp, Artificial Sequence; identical to SEQ ID NO: 3387
  Synthetic construct

SEQ ID NO: 7285 - DNA, 39 bp, Artificial Sequence; identical to SEQ ID NO: 3388
  Synthetic construct

SEQ ID NO: 7286 - DNA, 57 bp, Artificial Sequence; identical to SEQ ID NO: 3389
  Synthetic construct

SEQ ID NO: 7287 - DNA, 45 bp, Artificial Sequence; identical to SEQ ID NO: 3390
  Synthetic construct

SEQ ID NO: 7288 - DNA, 48 bp, Artificial Sequence; identical to SEQ ID NO: 3391
  Synthetic construct

SEQ ID NO: 7289 - DNA, 51 bp, Artificial Sequence; identical to SEQ ID NO: 3392
  Synthetic construct

SEQ ID NO: 7290 - DNA, 45 bp, Artificial Sequence; identical to SEQ ID NO: 3393
  Synthetic construct

SEQ ID NO: 7291 - DNA, 54 bp, Artificial Sequence; identical to SEQ ID NO: 3394
  Synthetic construct

SEQ ID NO: 7292 - DNA, 48 bp, Artificial Sequence; identical to SEQ ID NO: 3395
  Synthetic construct

SEQ ID NO: 7293 - DNA, 48 bp, Artificial Sequence; identical to SEQ ID NO: 3396
  Synthetic construct

SEQ ID NO: 7294 - DNA, 66 bp, Artificial Sequence; identical to SEQ ID NO: 3397
  Synthetic construct

SEQ ID NO: 7295 - DNA, 51 bp, Artificial Sequence; identical to SEQ ID NO: 3398
  Synthetic construct

SEQ ID NO: 7296 - DNA, 51 bp, Artificial Sequence; identical to SEQ ID NO: 3399
  Synthetic construct

SEQ ID NO: 7297 - DNA, 66 bp, Artificial Sequence; identical to SEQ ID NO: 3400
  Synthetic construct

SEQ ID NO: 7298 - DNA, 51 bp, Artificial Sequence; identical to SEQ ID NO: 3401
  Synthetic construct

SEQ ID NO: 7299 - DNA, 54 bp, Artificial Sequence; identical to SEQ ID NO: 3402
  Synthetic construct

SEQ ID NO: 7300 - DNA, 60 bp, Artificial Sequence; identical to SEQ ID NO: 3403
  Synthetic construct

SEQ ID NO: 7301 - DNA, 42 bp, Artificial Sequence; identical to SEQ ID NO: 3404
  Synthetic construct

SEQ ID NO: 7302 - DNA, 51 bp, Artificial Sequence; identical to SEQ ID NO: 3405
  Synthetic construct

SEQ ID NO: 7303 - DNA, 39 bp, Artificial Sequence; identical to SEQ ID NO: 3406
  Synthetic construct

SEQ ID NO: 7304 - DNA, 48 bp, Artificial Sequence; identical to SEQ ID NO: 3407
  Synthetic construct

SEQ ID NO: 7305 - DNA, 66 bp, Artificial Sequence; identical to SEQ ID NO: 3408
  Synthetic construct

SEQ ID NO: 7306 - DNA, 57 bp, Artificial Sequence; identical to SEQ ID NO: 3409
  Synthetic construct

SEQ ID NO: 7307 - DNA, 45 bp, Artificial Sequence; identical to SEQ ID NO: 3410
  Synthetic construct

SEQ ID NO: 7308 - DNA, 63 bp, Artificial Sequence; identical to SEQ ID NO: 3411
  Synthetic construct

SEQ ID NO: 7309 - DNA, 39 bp, Artificial Sequence; identical to SEQ ID NO: 3412
  Synthetic construct

SEQ ID NO: 7310 - DNA, 48 bp, Artificial Sequence; identical to SEQ ID NO: 3413
  Synthetic construct

SEQ ID NO: 7311 - DNA, 60 bp, Artificial Sequence; identical to SEQ ID NO: 3414
  Synthetic construct

SEQ ID NO: 7312 - DNA, 60 bp, Artificial Sequence; identical to SEQ ID NO: 3415
  Synthetic construct

SEQ ID NO: 7313 - DNA, 45 bp, Artificial Sequence; identical to SEQ ID NO: 3416
  Synthetic construct

SEQ ID NO: 7314 - DNA, 54 bp, Artificial Sequence; identical to SEQ ID NO: 3417
  Synthetic construct

SEQ ID NO: 7315 - DNA, 42 bp, Artificial Sequence; identical to SEQ ID NO: 3418
  Synthetic construct

SEQ ID NO: 7316 - DNA, 63 bp, Artificial Sequence; identical to SEQ ID NO: 3419
  Synthetic construct

SEQ ID NO: 7317 - DNA, 54 bp, Artificial Sequence; identical to SEQ ID NO: 3420
  Synthetic construct

SEQ ID NO: 7318 - DNA, 42 bp, Artificial Sequence; identical to SEQ ID NO: 3421
  Synthetic construct

SEQ ID NO: 7319 - DNA, 84 bp, Artificial Sequence; identical to SEQ ID NO: 3422
  Synthetic construct

SEQ ID NO: 7320 - DNA, 57 bp, Artificial Sequence; identical to SEQ ID NO: 3423
  Synthetic construct

SEQ ID NO: 7321 - DNA, 30 bp, Artificial Sequence; identical to SEQ ID NO: 3424
  Synthetic construct

SEQ ID NO: 7322 - DNA, 39 bp, Artificial Sequence; identical to SEQ ID NO: 3425
  Synthetic construct

SEQ ID NO: 7323 - DNA, 75 bp, Artificial Sequence; identical to SEQ ID NO: 3426
  Synthetic construct

SEQ ID NO: 7324 - DNA, 36 bp, Artificial Sequence; identical to SEQ ID NO: 3427
  Synthetic construct

SEQ ID NO: 7325 - DNA, 63 bp, Artificial Sequence; identical to SEQ ID NO: 3428
  Synthetic construct

SEQ ID NO: 7326 - DNA, 27 bp, Artificial Sequence
  Synthetic construct
tgtgcgagagacgagaacgactactgg

SEQ ID NO: 7327 - DNA, 42 bp, Artificial Sequence; identical to SEQ ID NO: 3430
  Synthetic construct

SEQ ID NO: 7328 - DNA, 69 bp, Artificial Sequence; identical to SEQ ID NO: 3431
  Synthetic construct

SEQ ID NO: 7329 - DNA, 27 bp, Artificial Sequence
  Synthetic construct
tgtgcgagagctttcctggacgtctgg

SEQ ID NO: 7330 - DNA, 63 bp, Artificial Sequence; identical to SEQ ID NO: 3433
  Synthetic construct

SEQ ID NO: 7331 - DNA, 66 bp, Artificial Sequence; identical to SEQ ID NO: 3434
  Synthetic construct

SEQ ID NO: 7332 - DNA, 66 bp, Artificial Sequence; identical to SEQ ID NO: 3435
  Synthetic construct

SEQ ID NO: 7333 - DNA, 48 bp, Artificial Sequence; identical to SEQ ID NO: 3436
  Synthetic construct

SEQ ID NO: 7334 - DNA, 33 bp, Artificial Sequence; identical to SEQ ID NO: 3437
  Synthetic construct

SEQ ID NO: 7335 - DNA, 60 bp, Artificial Sequence; identical to SEQ ID NO: 3438
  Synthetic construct

SEQ ID NO: 7336 - DNA, 54 bp, Artificial Sequence; identical to SEQ ID NO: 3439
  Synthetic construct

SEQ ID NO: 7337 - DNA, 66 bp, Artificial Sequence; identical to SEQ ID NO: 3440
  Synthetic construct

SEQ ID NO: 7338 - DNA, 45 bp, Artificial Sequence; identical to SEQ ID NO: 3441
  Synthetic construct

SEQ ID NO: 7339 - DNA, 42 bp, Artificial Sequence; identical to SEQ ID NO: 3442
  Synthetic construct

SEQ ID NO: 7340 - DNA, 57 bp, Artificial Sequence; identical to SEQ ID NO: 3443
  Synthetic construct

SEQ ID NO: 7341 - DNA, 66 bp, Artificial Sequence; identical to SEQ ID NO: 3444
  Synthetic construct

SEQ ID NO: 7342 - DNA, 66 bp, Artificial Sequence; identical to SEQ ID NO: 3445
  Synthetic construct

SEQ ID NO: 7343 - DNA, 66 bp, Artificial Sequence; identical to SEQ ID NO: 3446
  Synthetic construct

SEQ ID NO: 7344 - DNA, 51 bp, Artificial Sequence; identical to SEQ ID NO: 3447
  Synthetic construct

SEQ ID NO: 7345 - DNA, 45 bp, Artificial Sequence; identical to SEQ ID NO: 3448
  Synthetic construct

SEQ ID NO: 7346 - DNA, 54 bp, Artificial Sequence; identical to SEQ ID NO: 3449
  Synthetic construct

SEQ ID NO: 7347 - DNA, 51 bp, Artificial Sequence; identical to SEQ ID NO: 3450
  Synthetic construct

SEQ ID NO: 7348 - DNA, 45 bp, Artificial Sequence; identical to SEQ ID NO: 3451
  Synthetic construct

SEQ ID NO: 7349 - DNA, 69 bp, Artificial Sequence; identical to SEQ ID NO: 3452
  Synthetic construct

SEQ ID NO: 7350 - DNA, 66 bp, Artificial Sequence; identical to SEQ ID NO: 3453
  Synthetic construct

SEQ ID NO: 7351 - DNA, 72 bp, Artificial Sequence; identical to SEQ ID NO: 3454
  Synthetic construct

SEQ ID NO: 7352 - DNA, 39 bp, Artificial Sequence; identical to SEQ ID NO: 3455
  Synthetic construct

SEQ ID NO: 7353 - DNA, 48 bp, Artificial Sequence; identical to SEQ ID NO: 3456
  Synthetic construct

SEQ ID NO: 7354 - DNA, 63 bp, Artificial Sequence; identical to SEQ ID NO: 3457
  Synthetic construct

SEQ ID NO: 7355 - DNA, 60 bp, Artificial Sequence; identical to SEQ ID NO: 3458
  Synthetic construct

SEQ ID NO: 7356 - DNA, 39 bp, Artificial Sequence; identical to SEQ ID NO: 3459
  Synthetic construct

SEQ ID NO: 7357 - DNA, 78 bp, Artificial Sequence; identical to SEQ ID NO: 3460
  Synthetic construct

SEQ ID NO: 7358 - DNA, 63 bp, Artificial Sequence; identical to SEQ ID NO: 3461
  Synthetic construct

SEQ ID NO: 7359 - DNA, 45 bp, Artificial Sequence; identical to SEQ ID NO: 3462
  Synthetic construct

SEQ ID NO: 7360 - DNA, 45 bp, Artificial Sequence; identical to SEQ ID NO: 3463
  Synthetic construct

SEQ ID NO: 7361 - DNA, 45 bp, Artificial Sequence; identical to SEQ ID NO: 3464
  Synthetic construct

SEQ ID NO: 7362 - DNA, 81 bp, Artificial Sequence; identical to SEQ ID NO: 3465
  Synthetic construct

SEQ ID NO: 7363 - DNA, 54 bp, Artificial Sequence; identical to SEQ ID NO: 3466
  Synthetic construct

SEQ ID NO: 7364 - DNA, 54 bp, Artificial Sequence; identical to SEQ ID NO: 3467
  Synthetic construct

SEQ ID NO: 7365 - DNA, 45 bp, Artificial Sequence; identical to SEQ ID NO: 3468
  Synthetic construct

SEQ ID NO: 7366 - DNA, 45 bp, Artificial Sequence; identical to SEQ ID NO: 3469
  Synthetic construct

SEQ ID NO: 7367 - DNA, 51 bp, Artificial Sequence; identical to SEQ ID NO: 3470
  Synthetic construct

SEQ ID NO: 7368 - DNA, 57 bp, Artificial Sequence; identical to SEQ ID NO: 3471
  Synthetic construct

SEQ ID NO: 7369 - DNA, 51 bp, Artificial Sequence; identical to SEQ ID NO: 3472
  Synthetic construct

SEQ ID NO: 7370 - DNA, 60 bp, Artificial Sequence; identical to SEQ ID NO: 3473
  Synthetic construct

SEQ ID NO: 7371 - DNA, 54 bp, Artificial Sequence; identical to SEQ ID NO: 3474
  Synthetic construct

SEQ ID NO: 7372 - DNA, 51 bp, Artificial Sequence; identical to SEQ ID NO: 3475
  Synthetic construct

SEQ ID NO: 7373 - DNA, 48 bp, Artificial Sequence; identical to SEQ ID NO: 3476
  Synthetic construct

SEQ ID NO: 7374 - DNA, 57 bp, Artificial Sequence; identical to SEQ ID NO: 3477
  Synthetic construct

SEQ ID NO: 7375 - DNA, 48 bp, Artificial Sequence; identical to SEQ ID NO: 3478
  Synthetic construct

SEQ ID NO: 7376 - DNA, 54 bp, Artificial Sequence; identical to SEQ ID NO: 3479
  Synthetic construct

SEQ ID NO: 7377 - DNA, 54 bp, Artificial Sequence; identical to SEQ ID NO: 3480
  Synthetic construct

SEQ ID NO: 7378 - DNA, 66 bp, Artificial Sequence; identical to SEQ ID NO: 3481
  Synthetic construct

SEQ ID NO: 7379 - DNA, 51 bp, Artificial Sequence; identical to SEQ ID NO: 3482
  Synthetic construct

SEQ ID NO: 7380 - DNA, 39 bp, Artificial Sequence; identical to SEQ ID NO: 3483
  Synthetic construct

SEQ ID NO: 7381 - DNA, 84 bp, Artificial Sequence; identical to SEQ ID NO: 3485
  Synthetic construct

SEQ ID NO: 7382 - DNA, 36 bp, Artificial Sequence; identical to SEQ ID NO: 3486
  Synthetic construct

SEQ ID NO: 7383 - DNA, 45 bp, Artificial Sequence; identical to SEQ ID NO: 3487
  Synthetic construct

SEQ ID NO: 7384 - DNA, 51 bp, Artificial Sequence; identical to SEQ ID NO: 3488
  Synthetic construct

SEQ ID NO: 7385 - DNA, 60 bp, Artificial Sequence; identical to SEQ ID NO: 3489
  Synthetic construct

SEQ ID NO: 7386 - DNA, 72 bp, Artificial Sequence; identical to SEQ ID NO: 3490
  Synthetic construct

SEQ ID NO: 7387 - DNA, 54 bp, Artificial Sequence; identical to SEQ ID NO: 3491
  Synthetic construct

SEQ ID NO: 7388 - DNA, 48 bp, Artificial Sequence; identical to SEQ ID NO: 3492
  Synthetic construct

SEQ ID NO: 7389 - DNA, 51 bp, Artificial Sequence; identical to SEQ ID NO: 3493
  Synthetic construct

SEQ ID NO: 7390 - DNA, 45 bp, Artificial Sequence; identical to SEQ ID NO: 3494
  Synthetic construct

SEQ ID NO: 7391 - DNA, 63 bp, Artificial Sequence; identical to SEQ ID NO: 3495
  Synthetic construct

SEQ ID NO: 7392 - DNA, 45 bp, Artificial Sequence; identical to SEQ ID NO: 3496
  Synthetic construct

SEQ ID NO: 7393 - DNA, 51 bp, Artificial Sequence; identical to SEQ ID NO: 3497
  Synthetic construct

SEQ ID NO: 7394 - DNA, 45 bp, Artificial Sequence; identical to SEQ ID NO: 3498
  Synthetic construct

SEQ ID NO: 7395 - DNA, 72 bp, Artificial Sequence; identical to SEQ ID NO: 3499
  Synthetic construct

SEQ ID NO: 7396 - DNA, 48 bp, Artificial Sequence; identical to SEQ ID NO: 3500
  Synthetic construct

SEQ ID NO: 7397 - DNA, 21 bp, Artificial Sequence
  Synthetic construct
tgtgcgaaagacctctcttgt

SEQ ID NO: 7398 - DNA, 54 bp, Artificial Sequence; identical to SEQ ID NO: 3503
  Synthetic construct

SEQ ID NO: 7399 - DNA, 51 bp, Artificial Sequence; identical to SEQ ID NO: 3504
  Synthetic construct

SEQ ID NO: 7400 - DNA, 63 bp, Artificial Sequence; identical to SEQ ID NO: 3505
  Synthetic construct

SEQ ID NO: 7401 - DNA, 42 bp, Artificial Sequence; identical to SEQ ID NO: 3506
  Synthetic construct

SEQ ID NO: 7402 - DNA, 57 bp, Artificial Sequence; identical to SEQ ID NO: 3507
  Synthetic construct

SEQ ID NO: 7403 - DNA, 60 bp, Artificial Sequence; identical to SEQ ID NO: 3508
  Synthetic construct

SEQ ID NO: 7404 - DNA, 48 bp, Artificial Sequence; identical to SEQ ID NO: 3509
  Synthetic construct

SEQ ID NO: 7405 - DNA, 63 bp, Artificial Sequence; identical to SEQ ID NO: 3510
  Synthetic construct

SEQ ID NO: 7406 - DNA, 60 bp, Artificial Sequence; identical to SEQ ID NO: 3511
  Synthetic construct

SEQ ID NO: 7407 - DNA, 48 bp, Artificial Sequence; identical to SEQ ID NO: 3512
  Synthetic construct

SEQ ID NO: 7408 - DNA, 42 bp, Artificial Sequence; identical to SEQ ID NO: 3513
  Synthetic construct

SEQ ID NO: 7409 - DNA, 33 bp, Artificial Sequence; identical to SEQ ID NO: 3514
  Synthetic construct

SEQ ID NO: 7410 - DNA, 51 bp, Artificial Sequence; identical to SEQ ID NO: 3515
  Synthetic construct

SEQ ID NO: 7411 - DNA, 39 bp, Artificial Sequence; identical to SEQ ID NO: 3516
  Synthetic construct

SEQ ID NO: 7412 - DNA, 57 bp, Artificial Sequence; identical to SEQ ID NO: 3517
  Synthetic construct

SEQ ID NO: 7413 - DNA, 48 bp, Artificial Sequence; identical to SEQ ID NO: 3518
  Synthetic construct

SEQ ID NO: 7414 - DNA, 51 bp, Artificial Sequence; identical to SEQ ID NO: 3519
  Synthetic construct

SEQ ID NO: 7415 - DNA, 48 bp, Artificial Sequence; identical to SEQ ID NO: 3520
  Synthetic construct

SEQ ID NO: 7416 - DNA, 57 bp, Artificial Sequence; identical to SEQ ID NO: 3521
  Synthetic construct

SEQ ID NO: 7417 - DNA, 60 bp, Artificial Sequence; identical to SEQ ID NO: 3522
  Synthetic construct

SEQ ID NO: 7418 - DNA, 45 bp, Artificial Sequence; identical to SEQ ID NO: 3523
  Synthetic construct

SEQ ID NO: 7419 - DNA, 51 bp, Artificial Sequence; identical to SEQ ID NO: 3524
  Synthetic construct

SEQ ID NO: 7420 - DNA, 48 bp, Artificial Sequence; identical to SEQ ID NO: 3525
  Synthetic construct

SEQ ID NO: 7421 - DNA, 51 bp, Artificial Sequence; identical to SEQ ID NO: 3526
  Synthetic construct

SEQ ID NO: 7422 - DNA, 36 bp, Artificial Sequence; identical to SEQ ID NO: 3527
  Synthetic construct

SEQ ID NO: 7423 - DNA, 69 bp, Artificial Sequence; identical to SEQ ID NO: 3528
  Synthetic construct

SEQ ID NO: 7424 - DNA, 48 bp, Artificial Sequence; identical to SEQ ID NO: 3529
  Synthetic construct

SEQ ID NO: 7425 - DNA, 48 bp, Artificial Sequence; identical to SEQ ID NO: 3530
  Synthetic construct

SEQ ID NO: 7426 - DNA, 60 bp, Artificial Sequence; identical to SEQ ID NO: 3531
  Synthetic construct

SEQ ID NO: 7427 - DNA, 60 bp, Artificial Sequence; identical to SEQ ID NO: 3532
  Synthetic construct

SEQ ID NO: 7428 - DNA, 48 bp, Artificial Sequence; identical to SEQ ID NO: 1771
  Synthetic construct

SEQ ID NO: 7429 - DNA, 66 bp, Artificial Sequence; identical to SEQ ID NO: 3534
  Synthetic construct

SEQ ID NO: 7430 - DNA, 57 bp, Artificial Sequence; identical to SEQ ID NO: 3535
  Synthetic construct

SEQ ID NO: 7431 - DNA, 66 bp, Artificial Sequence; identical to SEQ ID NO: 3536
  Synthetic construct

SEQ ID NO: 7432 - DNA, 72 bp, Artificial Sequence; identical to SEQ ID NO: 3537
  Synthetic construct

SEQ ID NO: 7433 - DNA, 39 bp, Artificial Sequence; identical to SEQ ID NO: 3538
  Synthetic construct

SEQ ID NO: 7434 - DNA, 36 bp, Artificial Sequence; identical to SEQ ID NO: 3539
  Synthetic construct

SEQ ID NO: 7435 - DNA, 57 bp, Artificial Sequence; identical to SEQ ID NO: 3540
  Synthetic construct

SEQ ID NO: 7436 - DNA, 69 bp, Artificial Sequence; identical to SEQ ID NO: 3541
  Synthetic construct

SEQ ID NO: 7437 - DNA, 60 bp, Artificial Sequence; identical to SEQ ID NO: 3542
  Synthetic construct

SEQ ID NO: 7438 - DNA, 51 bp, Artificial Sequence; identical to SEQ ID NO: 3543
  Synthetic construct

SEQ ID NO: 7439 - DNA, 48 bp, Artificial Sequence; identical to SEQ ID NO: 3544
  Synthetic construct

SEQ ID NO: 7440 - DNA, 30 bp, Artificial Sequence; identical to SEQ ID NO: 3545
  Synthetic construct

SEQ ID NO: 7441 - DNA, 66 bp, Artificial Sequence; identical to SEQ ID NO: 3546
  Synthetic construct

SEQ ID NO: 7442 - DNA, 69 bp, Artificial Sequence; identical to SEQ ID NO: 3547
  Synthetic construct

SEQ ID NO: 7443 - DNA, 33 bp, Artificial Sequence; identical to SEQ ID NO: 3548
  Synthetic construct

SEQ ID NO: 7444 - DNA, 60 bp, Artificial Sequence; identical to SEQ ID NO: 3549
  Synthetic construct

SEQ ID NO: 7445 - DNA, 39 bp, Artificial Sequence; identical to SEQ ID NO: 3550
  Synthetic construct

SEQ ID NO: 7446 - DNA, 48 bp, Artificial Sequence; identical to SEQ ID NO: 3551
  Synthetic construct

SEQ ID NO: 7447 - DNA, 24 bp, Artificial Sequence
  Synthetic construct
tgtgtaaaacaggctctgaatact

SEQ ID NO: 7448 - DNA, 54 bp, Artificial Sequence; identical to SEQ ID NO: 3553
  Synthetic construct

SEQ ID NO: 7449 - DNA, 63 bp, Artificial Sequence; identical to SEQ ID NO: 3554
  Synthetic construct

SEQ ID NO: 7450 - DNA, 39 bp, Artificial Sequence; identical to SEQ ID NO: 3555
  Synthetic construct

SEQ ID NO: 7451 - DNA, 60 bp, Artificial Sequence; identical to SEQ ID NO: 3556
  Synthetic construct

SEQ ID NO: 7452 - DNA, 60 bp, Artificial Sequence; identical to SEQ ID NO: 3557
  Synthetic construct

SEQ ID NO: 7453 - DNA, 51 bp, Artificial Sequence; identical to SEQ ID NO: 3558
  Synthetic construct

SEQ ID NO: 7454 - DNA, 39 bp, Artificial Sequence; identical to SEQ ID NO: 3559
  Synthetic construct

SEQ ID NO: 7455 - DNA, 69 bp, Artificial Sequence; identical to SEQ ID NO: 3560
  Synthetic construct

SEQ ID NO: 7456 - DNA, 57 bp, Artificial Sequence; identical to SEQ ID NO: 3561
  Synthetic construct

SEQ ID NO: 7457 - DNA, 57 bp, Artificial Sequence; identical to SEQ ID NO: 3563
  Synthetic construct

SEQ ID NO: 7458 - DNA, 57 bp, Artificial Sequence; identical to SEQ ID NO: 3564
  Synthetic construct

SEQ ID NO: 7459 - DNA, 36 bp, Artificial Sequence; identical to SEQ ID NO: 3565
  Synthetic construct

SEQ ID NO: 7460 - DNA, 69 bp, Artificial Sequence; identical to SEQ ID NO: 3566
  Synthetic construct

SEQ ID NO: 7461 - DNA, 48 bp, Artificial Sequence; identical to SEQ ID NO: 3567
  Synthetic construct

SEQ ID NO: 7462 - DNA, 48 bp, Artificial Sequence; identical to SEQ ID NO: 3568
  Synthetic construct

SEQ ID NO: 7463 - DNA, 57 bp, Artificial Sequence; identical to SEQ ID NO: 3569
  Synthetic construct

SEQ ID NO: 7464 - DNA, 39 bp, Artificial Sequence; identical to SEQ ID NO: 3570
  Synthetic construct

SEQ ID NO: 7465 - DNA, 51 bp, Artificial Sequence; identical to SEQ ID NO: 3571
  Synthetic construct

SEQ ID NO: 7466 - DNA, 42 bp, Artificial Sequence; identical to SEQ ID NO: 3572
  Synthetic construct

SEQ ID NO: 7467 - DNA, 39 bp, Artificial Sequence; identical to SEQ ID NO: 3573
  Synthetic construct

SEQ ID NO: 7468 - DNA, 54 bp, Artificial Sequence; identical to SEQ ID NO: 3574
  Synthetic construct

SEQ ID NO: 7469 - DNA, 60 bp, Artificial Sequence; identical to SEQ ID NO: 3575
  Synthetic construct

SEQ ID NO: 7470 - DNA, 57 bp, Artificial Sequence; identical to SEQ ID NO: 3576
  Synthetic construct

SEQ ID NO: 7471 - DNA, 51 bp, Artificial Sequence; identical to SEQ ID NO: 3577
  Synthetic construct

SEQ ID NO: 7472 - DNA, 63 bp, Artificial Sequence; identical to SEQ ID NO: 3578
  Synthetic construct

SEQ ID NO: 7473 - DNA, 54 bp, Artificial Sequence; identical to SEQ ID NO: 3579
  Synthetic construct

SEQ ID NO: 7474 - DNA, 60 bp, Artificial Sequence; identical to SEQ ID NO: 3580
  Synthetic construct

SEQ ID NO: 7475 - DNA, 51 bp, Artificial Sequence; identical to SEQ ID NO: 3581
  Synthetic construct

SEQ ID NO: 7476 - DNA, 51 bp, Artificial Sequence; identical to SEQ ID NO: 3582
  Synthetic construct

SEQ ID NO: 7477 - DNA, 48 bp, Artificial Sequence; identical to SEQ ID NO: 3583
  Synthetic construct

SEQ ID NO: 7478 - DNA, 48 bp, Artificial Sequence; identical to SEQ ID NO: 3584
  Synthetic construct

SEQ ID NO: 7479 - DNA, 45 bp, Artificial Sequence; identical to SEQ ID NO: 3585
  Synthetic construct

SEQ ID NO: 7480 - DNA, 72 bp, Artificial Sequence; identical to SEQ ID NO: 3586
  Synthetic construct

SEQ ID NO: 7481 - DNA, 48 bp, Artificial Sequence; identical to SEQ ID NO: 3587
  Synthetic construct

SEQ ID NO: 7482 - DNA, 45 bp, Artificial Sequence; identical to SEQ ID NO: 3588
  Synthetic construct

SEQ ID NO: 7483 - DNA, 48 bp, Artificial Sequence; identical to SEQ ID NO: 3589
  Synthetic construct

SEQ ID NO: 7484 - DNA, 51 bp, Artificial Sequence; identical to SEQ ID NO: 3590
  Synthetic construct

SEQ ID NO: 7485 - DNA, 48 bp, Artificial Sequence; identical to SEQ ID NO: 3591
  Synthetic construct

SEQ ID NO: 7486 - DNA, 63 bp, Artificial Sequence; identical to SEQ ID NO: 3593
  Synthetic construct

SEQ ID NO: 7487 - DNA, 48 bp, Artificial Sequence; identical to SEQ ID NO: 3594
  Synthetic construct

SEQ ID NO: 7488 - DNA, 51 bp, Artificial Sequence; identical to SEQ ID NO: 3595
  Synthetic construct

SEQ ID NO: 7489 - DNA, 66 bp, Artificial Sequence; identical to SEQ ID NO: 3596
  Synthetic construct

SEQ ID NO: 7490 - DNA, 60 bp, Artificial Sequence; identical to SEQ ID NO: 3597
  Synthetic construct

SEQ ID NO: 7491 - DNA, 66 bp, Artificial Sequence; identical to SEQ ID NO: 3598
  Synthetic construct

SEQ ID NO: 7492 - DNA, 39 bp, Artificial Sequence; identical to SEQ ID NO: 3599
  Synthetic construct

SEQ ID NO: 7493 - DNA, 42 bp, Artificial Sequence; identical to SEQ ID NO: 3600
  Synthetic construct

SEQ ID NO: 7494 - DNA, 63 bp, Artificial Sequence; identical to SEQ ID NO: 3601
  Synthetic construct

SEQ ID NO: 7495 - DNA, 63 bp, Artificial Sequence; identical to SEQ ID NO: 3602
  Synthetic construct

SEQ ID NO: 7496 - DNA, 63 bp, Artificial Sequence; identical to SEQ ID NO: 3603
  Synthetic construct

SEQ ID NO: 7497 - DNA, 45 bp, Artificial Sequence; identical to SEQ ID NO: 3604
  Synthetic construct

SEQ ID NO: 7498 - DNA, 60 bp, Artificial Sequence; identical to SEQ ID NO: 3605
  Synthetic construct

SEQ ID NO: 7499 - DNA, 48 bp, Artificial Sequence; identical to SEQ ID NO: 3606
  Synthetic construct

SEQ ID NO: 7500 - DNA, 54 bp, Artificial Sequence; identical to SEQ ID NO: 3607
  Synthetic construct

SEQ ID NO: 7501 - DNA, 48 bp, Artificial Sequence; identical to SEQ ID NO: 3608
  Synthetic construct

SEQ ID NO: 7502 - DNA, 33 bp, Artificial Sequence; identical to SEQ ID NO: 3609
  Synthetic construct

SEQ ID NO: 7503 - DNA, 51 bp, Artificial Sequence; identical to SEQ ID NO: 3610
  Synthetic construct

SEQ ID NO: 7504 - DNA, 51 bp, Artificial Sequence; identical to SEQ ID NO: 3611
  Synthetic construct

SEQ ID NO: 7505 - DNA, 51 bp, Artificial Sequence; identical to SEQ ID NO: 3612
  Synthetic construct

SEQ ID NO: 7506 - DNA, 48 bp, Artificial Sequence; identical to SEQ ID NO: 3613
  Synthetic construct

SEQ ID NO: 7507 - DNA, 60 bp, Artificial Sequence; identical to SEQ ID NO: 3614
  Synthetic construct

SEQ ID NO: 7508 - DNA, 57 bp, Artificial Sequence; identical to SEQ ID NO: 3615
  Synthetic construct

SEQ ID NO: 7509 - DNA, 63 bp, Artificial Sequence; identical to SEQ ID NO: 3616
  Synthetic construct

SEQ ID NO: 7510 - DNA, 45 bp, Artificial Sequence; identical to SEQ ID NO: 3617
  Synthetic construct

SEQ ID NO: 7511 - DNA, 45 bp, Artificial Sequence; identical to SEQ ID NO: 3618
  Synthetic construct

SEQ ID NO: 7512 - DNA, 42 bp, Artificial Sequence; identical to SEQ ID NO: 3619
  Synthetic construct

SEQ ID NO: 7513 - DNA, 48 bp, Artificial Sequence; identical to SEQ ID NO: 3620
  Synthetic construct

SEQ ID NO: 7514 - DNA, 42 bp, Artificial Sequence; identical to SEQ ID NO: 3621
  Synthetic construct

SEQ ID NO: 7515 - DNA, 30 bp, Artificial Sequence; identical to SEQ ID NO: 3622
  Synthetic construct

SEQ ID NO: 7516 - DNA, 45 bp, Artificial Sequence; identical to SEQ ID NO: 3623
  Synthetic construct

SEQ ID NO: 7517 - DNA, 42 bp, Artificial Sequence; identical to SEQ ID NO: 3624
  Synthetic construct

SEQ ID NO: 7518 - DNA, 39 bp, Artificial Sequence; identical to SEQ ID NO: 3625
  Synthetic construct

SEQ ID NO: 7519 - DNA, 66 bp, Artificial Sequence; identical to SEQ ID NO: 3626
  Synthetic construct

SEQ ID NO: 7520 - DNA, 54 bp, Artificial Sequence; identical to SEQ ID NO: 3627
  Synthetic construct

SEQ ID NO: 7521 - DNA, 45 bp, Artificial Sequence; identical to SEQ ID NO: 3628
  Synthetic construct

SEQ ID NO: 7522 - DNA, 42 bp, Artificial Sequence; identical to SEQ ID NO: 3629
  Synthetic construct

SEQ ID NO: 7523 - DNA, 42 bp, Artificial Sequence; identical to SEQ ID NO: 3630
  Synthetic construct

SEQ ID NO: 7524 - DNA, 39 bp, Artificial Sequence; identical to SEQ ID NO: 3631
  Synthetic construct

SEQ ID NO: 7525 - DNA, 60 bp, Artificial Sequence; identical to SEQ ID NO: 3632
  Synthetic construct

SEQ ID NO: 7526 - DNA, 42 bp, Artificial Sequence; identical to SEQ ID NO: 3633
  Synthetic construct

SEQ ID NO: 7527 - DNA, 54 bp, Artificial Sequence; identical to SEQ ID NO: 3634
  Synthetic construct

SEQ ID NO: 7528 - DNA, 57 bp, Artificial Sequence; identical to SEQ ID NO: 3635
  Synthetic construct

SEQ ID NO: 7529 - DNA, 42 bp, Artificial Sequence; identical to SEQ ID NO: 3636
  Synthetic construct

SEQ ID NO: 7530 - DNA, 60 bp, Artificial Sequence; identical to SEQ ID NO: 3637
  Synthetic construct

SEQ ID NO: 7531 - DNA, 54 bp, Artificial Sequence; identical to SEQ ID NO: 3638
  Synthetic construct

SEQ ID NO: 7532 - DNA, 42 bp, Artificial Sequence; identical to SEQ ID NO: 3639
  Synthetic construct

SEQ ID NO: 7533 - DNA, 57 bp, Artificial Sequence; identical to SEQ ID NO: 3640
  Synthetic construct

SEQ ID NO: 7534 - DNA, 36 bp, Artificial Sequence; identical to SEQ ID NO: 3641
  Synthetic construct

SEQ ID NO: 7535 - DNA, 54 bp, Artificial Sequence; identical to SEQ ID NO: 3642
  Synthetic construct

SEQ ID NO: 7536 - DNA, 51 bp, Artificial Sequence; identical to SEQ ID NO: 3643
  Synthetic construct

SEQ ID NO: 7537 - DNA, 36 bp, Artificial Sequence; identical to SEQ ID NO: 3644
  Synthetic construct

SEQ ID NO: 7538 - DNA, 63 bp, Artificial Sequence; identical to SEQ ID NO: 3645
  Synthetic construct

SEQ ID NO: 7539 - DNA, 45 bp, Artificial Sequence; identical to SEQ ID NO: 3646
  Synthetic construct

SEQ ID NO: 7540 - DNA, 42 bp, Artificial Sequence; identical to SEQ ID NO: 3647
  Synthetic construct

SEQ ID NO: 7541 - DNA, 48 bp, Artificial Sequence; identical to SEQ ID NO: 3648
  Synthetic construct

SEQ ID NO: 7542 - DNA, 60 bp, Artificial Sequence; identical to SEQ ID NO: 3649
  Synthetic construct

SEQ ID NO: 7543 - DNA, 54 bp, Artificial Sequence; identical to SEQ ID NO: 3650
  Synthetic construct

SEQ ID NO: 7544 - DNA, 48 bp, Artificial Sequence; identical to SEQ ID NO: 3651
  Synthetic construct

SEQ ID NO: 7545 - DNA, 42 bp, Artificial Sequence; identical to SEQ ID NO: 3652
  Synthetic construct

SEQ ID NO: 7546 - DNA, 42 bp, Artificial Sequence; identical to SEQ ID NO: 3653
  Synthetic construct

SEQ ID NO: 7547 - DNA, 51 bp, Artificial Sequence; identical to SEQ ID NO: 3654
  Synthetic construct

SEQ ID NO: 7548 - DNA, 51 bp, Artificial Sequence; identical to SEQ ID NO: 3655
  Synthetic construct

SEQ ID NO: 7549 - DNA, 63 bp, Artificial Sequence; identical to SEQ ID NO: 3656
  Synthetic construct

SEQ ID NO: 7550 - DNA, 57 bp, Artificial Sequence; identical to SEQ ID NO: 3657
  Synthetic construct

SEQ ID NO: 7551 - DNA, 66 bp, Artificial Sequence; identical to SEQ ID NO: 3658
  Synthetic construct

SEQ ID NO: 7552 - DNA, 57 bp, Artificial Sequence; identical to SEQ ID NO: 3659
  Synthetic construct

SEQ ID NO: 7553 - DNA, 54 bp, Artificial Sequence; identical to SEQ ID NO: 3660
  Synthetic construct

SEQ ID NO: 7554 - DNA, 54 bp, Artificial Sequence; identical to SEQ ID NO: 3661
  Synthetic construct

SEQ ID NO: 7555 - DNA, 42 bp, Artificial Sequence; identical to SEQ ID NO: 3662
  Synthetic construct

SEQ ID NO: 7556 - DNA, 60 bp, Artificial Sequence; identical to SEQ ID NO: 3663
  Synthetic construct

SEQ ID NO: 7557 - DNA, 54 bp, Artificial Sequence; identical to SEQ ID NO: 3664
  Synthetic construct

SEQ ID NO: 7558 - DNA, 69 bp, Artificial Sequence; identical to SEQ ID NO: 3665
  Synthetic construct

SEQ ID NO: 7559 - DNA, 42 bp, Artificial Sequence; identical to SEQ ID NO: 1770
  Synthetic construct

SEQ ID NO: 7560 - DNA, 33 bp, Artificial Sequence; identical to SEQ ID NO: 3667
  Synthetic construct

SEQ ID NO: 7561 - DNA, 51 bp, Artificial Sequence; identical to SEQ ID NO: 3668
  Synthetic construct

SEQ ID NO: 7562 - DNA, 36 bp, Artificial Sequence; identical to SEQ ID NO: 3669
  Synthetic construct

SEQ ID NO: 7563 - DNA, 54 bp, Artificial Sequence; identical to SEQ ID NO: 3670
  Synthetic construct

SEQ ID NO: 7564 - DNA, 51 bp, Artificial Sequence; identical to SEQ ID NO: 3671
  Synthetic construct

SEQ ID NO: 7565 - DNA, 54 bp, Artificial Sequence; identical to SEQ ID NO: 3672
  Synthetic construct

SEQ ID NO: 7566 - DNA, 51 bp, Artificial Sequence; identical to SEQ ID NO: 3673
  Synthetic construct

SEQ ID NO: 7567 - DNA, 45 bp, Artificial Sequence; identical to SEQ ID NO: 3674
  Synthetic construct

SEQ ID NO: 7568 - DNA, 57 bp, Artificial Sequence; identical to SEQ ID NO: 3675
  Synthetic construct

SEQ ID NO: 7569 - DNA, 33 bp, Artificial Sequence; identical to SEQ ID NO: 3676
  Synthetic construct

SEQ ID NO: 7570 - DNA, 69 bp, Artificial Sequence; identical to SEQ ID NO: 3677
  Synthetic construct

SEQ ID NO: 7571 - DNA, 66 bp, Artificial Sequence; identical to SEQ ID NO: 3678
  Synthetic construct

SEQ ID NO: 7572 - DNA, 54 bp, Artificial Sequence; identical to SEQ ID NO: 3679
  Synthetic construct

SEQ ID NO: 7573 - DNA, 57 bp, Artificial Sequence; identical to SEQ ID NO: 3680
  Synthetic construct

SEQ ID NO: 7574 - DNA, 48 bp, Artificial Sequence; identical to SEQ ID NO: 3681
  Synthetic construct

SEQ ID NO: 7575 - DNA, 54 bp, Artificial Sequence; identical to SEQ ID NO: 1773
  Synthetic construct

SEQ ID NO: 7576 - DNA, 72 bp, Artificial Sequence; identical to SEQ ID NO: 3683
  Synthetic construct

SEQ ID NO: 7577 - DNA, 54 bp, Artificial Sequence; identical to SEQ ID NO: 3684
  Synthetic construct

SEQ ID NO: 7578 - DNA, 51 bp, Artificial Sequence; identical to SEQ ID NO: 3685
  Synthetic construct

SEQ ID NO: 7579 - DNA, 45 bp, Artificial Sequence; identical to SEQ ID NO: 3686
  Synthetic construct

SEQ ID NO: 7580 - DNA, 63 bp, Artificial Sequence; identical to SEQ ID NO: 3687
  Synthetic construct

SEQ ID NO: 7581 - DNA, 66 bp, Artificial Sequence; identical to SEQ ID NO: 3688
  Synthetic construct

SEQ ID NO: 7582 - DNA, 42 bp, Artificial Sequence; identical to SEQ ID NO: 3689
  Synthetic construct

SEQ ID NO: 7583 - DNA, 39 bp, Artificial Sequence; identical to SEQ ID NO: 3690
  Synthetic construct

SEQ ID NO: 7584 - DNA, 63 bp, Artificial Sequence; identical to SEQ ID NO: 3691
  Synthetic construct

SEQ ID NO: 7585 - DNA, 51 bp, Artificial Sequence; identical to SEQ ID NO: 3692
  Synthetic construct

SEQ ID NO: 7586 - DNA, 48 bp, Artificial Sequence; identical to SEQ ID NO: 3693
  Synthetic construct

SEQ ID NO: 7587 - DNA, 42 bp, Artificial Sequence; identical to SEQ ID NO: 3694
  Synthetic construct

SEQ ID NO: 7588 - DNA, 30 bp, Artificial Sequence
  Synthetic construct
tgtactcgagataaaggaatgtatgactgg

SEQ ID NO: 7589 - DNA, 57 bp, Artificial Sequence; identical to SEQ ID NO: 1769
  Synthetic construct

SEQ ID NO: 7590 - DNA, 36 bp, Artificial Sequence; identical to SEQ ID NO: 3697
  Synthetic construct

SEQ ID NO: 7591 - DNA, 66 bp, Artificial Sequence; identical to SEQ ID NO: 3698
  Synthetic construct

SEQ ID NO: 7592 - DNA, 54 bp, Artificial Sequence; identical to SEQ ID NO: 3699
  Synthetic construct

SEQ ID NO: 7593 - DNA, 54 bp, Artificial Sequence; identical to SEQ ID NO: 3700
  Synthetic construct

SEQ ID NO: 7594 - DNA, 42 bp, Artificial Sequence; identical to SEQ ID NO: 3701
  Synthetic construct

SEQ ID NO: 7595 - DNA, 54 bp, Artificial Sequence; identical to SEQ ID NO: 3702
  Synthetic construct

SEQ ID NO: 7596 - DNA, 42 bp, Artificial Sequence; identical to SEQ ID NO: 3703
  Synthetic construct

SEQ ID NO: 7597 - DNA, 51 bp, Artificial Sequence; identical to SEQ ID NO: 3704
  Synthetic construct

SEQ ID NO: 7598 - DNA, 63 bp, Artificial Sequence; identical to SEQ ID NO: 3705
  Synthetic construct

SEQ ID NO: 7599 - DNA, 51 bp, Artificial Sequence; identical to SEQ ID NO: 3706
  Synthetic construct

SEQ ID NO: 7600 - DNA, 63 bp, Artificial Sequence; identical to SEQ ID NO: 3707
  Synthetic construct

SEQ ID NO: 7601 - DNA, 78 bp, Artificial Sequence; identical to SEQ ID NO: 3708
  Synthetic construct

SEQ ID NO: 7602 - DNA, 69 bp, Artificial Sequence; identical to SEQ ID NO: 3709
  Synthetic construct

SEQ ID NO: 7603 - DNA, 42 bp, Artificial Sequence; identical to SEQ ID NO: 3710
  Synthetic construct

SEQ ID NO: 7604 - DNA, 54 bp, Artificial Sequence; identical to SEQ ID NO: 3711
  Synthetic construct

SEQ ID NO: 7605 - DNA, 63 bp, Artificial Sequence; identical to SEQ ID NO: 3713
  Synthetic construct

SEQ ID NO: 7606 - DNA, 42 bp, Artificial Sequence; identical to SEQ ID NO: 3714
  Synthetic construct

SEQ ID NO: 7607 - DNA, 51 bp, Artificial Sequence; identical to SEQ ID NO: 3715
  Synthetic construct

SEQ ID NO: 7608 - DNA, 48 bp, Artificial Sequence; identical to SEQ ID NO: 3716
  Synthetic construct

SEQ ID NO: 7609 - DNA, 33 bp, Artificial Sequence; identical to SEQ ID NO: 3717
  Synthetic construct

SEQ ID NO: 7610 - DNA, 45 bp, Artificial Sequence; identical to SEQ ID NO: 3718
  Synthetic construct

SEQ ID NO: 7611 - DNA, 75 bp, Artificial Sequence; identical to SEQ ID NO: 3719
  Synthetic construct

SEQ ID NO: 7612 - DNA, 51 bp, Artificial Sequence; identical to SEQ ID NO: 3720
  Synthetic construct

SEQ ID NO: 7613 - DNA, 57 bp, Artificial Sequence; identical to SEQ ID NO: 3721
  Synthetic construct

SEQ ID NO: 7614 - DNA, 48 bp, Artificial Sequence; identical to SEQ ID NO: 3722
  Synthetic construct

SEQ ID NO: 7615 - DNA, 72 bp, Artificial Sequence; identical to SEQ ID NO: 3723
  Synthetic construct

SEQ ID NO: 7616 - DNA, 51 bp, Artificial Sequence; identical to SEQ ID NO: 3724
  Synthetic construct

SEQ ID NO: 7617 - DNA, 39 bp, Artificial Sequence; identical to SEQ ID NO: 3725
  Synthetic construct

SEQ ID NO: 7618 - DNA, 42 bp, Artificial Sequence; identical to SEQ ID NO: 3726
  Synthetic construct

SEQ ID NO: 7619 - DNA, 60 bp, Artificial Sequence; identical to SEQ ID NO: 3727
  Synthetic construct

SEQ ID NO: 7620 - DNA, 51 bp, Artificial Sequence; identical to SEQ ID NO: 3728
  Synthetic construct

SEQ ID NO: 7621 - DNA, 51 bp, Artificial Sequence; identical to SEQ ID NO: 3729
  Synthetic construct

SEQ ID NO: 7622 - DNA, 57 bp, Artificial Sequence; identical to SEQ ID NO: 3730
  Synthetic construct

SEQ ID NO: 7623 - DNA, 39 bp, Artificial Sequence; identical to SEQ ID NO: 3731
  Synthetic construct

SEQ ID NO: 7624 - DNA, 63 bp, Artificial Sequence; identical to SEQ ID NO: 3732
  Synthetic construct

SEQ ID NO: 7625 - DNA, 54 bp, Artificial Sequence; identical to SEQ ID NO: 3733
  Synthetic construct

SEQ ID NO: 7626 - DNA, 33 bp, Artificial Sequence; identical to SEQ ID NO: 3734
  Synthetic construct

SEQ ID NO: 7627 - DNA, 60 bp, Artificial Sequence; identical to SEQ ID NO: 3735
  Synthetic construct

SEQ ID NO: 7628 - DNA, 51 bp, Artificial Sequence; identical to SEQ ID NO: 3736
  Synthetic construct

SEQ ID NO: 7629 - DNA, 42 bp, Artificial Sequence; identical to SEQ ID NO: 3737
  Synthetic construct

SEQ ID NO: 7630 - DNA, 63 bp, Artificial Sequence; identical to SEQ ID NO: 3738
  Synthetic construct

SEQ ID NO: 7631 - DNA, 60 bp, Artificial Sequence; identical to SEQ ID NO: 3739
  Synthetic construct

SEQ ID NO: 7632 - DNA, 60 bp, Artificial Sequence; identical to SEQ ID NO: 3740
  Synthetic construct

SEQ ID NO: 7633 - DNA, 36 bp, Artificial Sequence; identical to SEQ ID NO: 3741
  Synthetic construct

SEQ ID NO: 7634 - DNA, 81 bp, Artificial Sequence; identical to SEQ ID NO: 3742
  Synthetic construct

SEQ ID NO: 7635 - DNA, 57 bp, Artificial Sequence; identical to SEQ ID NO: 3743
  Synthetic construct

SEQ ID NO: 7636 - DNA, 66 bp, Artificial Sequence; identical to SEQ ID NO: 3744
  Synthetic construct

SEQ ID NO: 7637 - DNA, 60 bp, Artificial Sequence; identical to SEQ ID NO: 3745
  Synthetic construct

SEQ ID NO: 7638 - DNA, 42 bp, Artificial Sequence; identical to SEQ ID NO: 3746
  Synthetic construct

SEQ ID NO: 7639 - DNA, 48 bp, Artificial Sequence; identical to SEQ ID NO: 3747
  Synthetic construct

SEQ ID NO: 7640 - DNA, 69 bp, Artificial Sequence; identical to SEQ ID NO: 3748
  Synthetic construct

SEQ ID NO: 7641 - DNA, 42 bp, Artificial Sequence; identical to SEQ ID NO: 3749
  Synthetic construct

SEQ ID NO: 7642 - DNA, 60 bp, Artificial Sequence; identical to SEQ ID NO: 3750
  Synthetic construct

SEQ ID NO: 7643 - DNA, 57 bp, Artificial Sequence; identical to SEQ ID NO: 3751
  Synthetic construct

SEQ ID NO: 7644 - DNA, 45 bp, Artificial Sequence; identical to SEQ ID NO: 3752
  Synthetic construct

SEQ ID NO: 7645 - DNA, 42 bp, Artificial Sequence; identical to SEQ ID NO: 3753
  Synthetic construct

SEQ ID NO: 7646 - DNA, 51 bp, Artificial Sequence; identical to SEQ ID NO: 3754
  Synthetic construct

SEQ ID NO: 7647 - DNA, 45 bp, Artificial Sequence; identical to SEQ ID NO: 3755
  Synthetic construct

SEQ ID NO: 7648 - DNA, 63 bp, Artificial Sequence; identical to SEQ ID NO: 3756
  Synthetic construct

SEQ ID NO: 7649 - DNA, 39 bp, Artificial Sequence; identical to SEQ ID NO: 3757
  Synthetic construct

SEQ ID NO: 7650 - DNA, 42 bp, Artificial Sequence; identical to SEQ ID NO: 3758
  Synthetic construct

SEQ ID NO: 7651 - DNA, 72 bp, Artificial Sequence; identical to SEQ ID NO: 3759
  Synthetic construct

SEQ ID NO: 7652 - DNA, 54 bp, Artificial Sequence; identical to SEQ ID NO: 3760
  Synthetic construct

SEQ ID NO: 7653 - DNA, 57 bp, Artificial Sequence; identical to SEQ ID NO: 3761
  Synthetic construct

SEQ ID NO: 7654 - DNA, 66 bp, Artificial Sequence; identical to SEQ ID NO: 3762
  Synthetic construct

SEQ ID NO: 7655 - DNA, 48 bp, Artificial Sequence; identical to SEQ ID NO: 3763
  Synthetic construct

SEQ ID NO: 7656 - DNA, 51 bp, Artificial Sequence; identical to SEQ ID NO: 3764
  Synthetic construct

SEQ ID NO: 7657 - DNA, 51 bp, Artificial Sequence; identical to SEQ ID NO: 3765
  Synthetic construct

SEQ ID NO: 7658 - DNA, 51 bp, Artificial Sequence; identical to SEQ ID NO: 3766
  Synthetic construct

SEQ ID NO: 7659 - DNA, 66 bp, Artificial Sequence; identical to SEQ ID NO: 3767
  Synthetic construct

SEQ ID NO: 7660 - DNA, 69 bp, Artificial Sequence; identical to SEQ ID NO: 3768
  Synthetic construct

SEQ ID NO: 7661 - DNA, 51 bp, Artificial Sequence; identical to SEQ ID NO: 3770
  Synthetic construct

SEQ ID NO: 7662 - DNA, 60 bp, Artificial Sequence; identical to SEQ ID NO: 3771
  Synthetic construct

SEQ ID NO: 7663 - DNA, 54 bp, Artificial Sequence; identical to SEQ ID NO: 3772
  Synthetic construct

SEQ ID NO: 7664 - DNA, 57 bp, Artificial Sequence; identical to SEQ ID NO: 3773
  Synthetic construct

SEQ ID NO: 7665 - DNA, 69 bp, Artificial Sequence; identical to SEQ ID NO: 3774
  Synthetic construct

SEQ ID NO: 7666 - DNA, 63 bp, Artificial Sequence; identical to SEQ ID NO: 3775
  Synthetic construct

SEQ ID NO: 7667 - DNA, 60 bp, Artificial Sequence; identical to SEQ ID NO: 3776
  Synthetic construct

SEQ ID NO: 7668 - DNA, 57 bp, Artificial Sequence; identical to SEQ ID NO: 3777
  Synthetic construct

SEQ ID NO: 7669 - DNA, 48 bp, Artificial Sequence; identical to SEQ ID NO: 3778
  Synthetic construct

SEQ ID NO: 7670 - DNA, 63 bp, Artificial Sequence; identical to SEQ ID NO: 3779
  Synthetic construct

SEQ ID NO: 7671 - DNA, 84 bp, Artificial Sequence; identical to SEQ ID NO: 3780
  Synthetic construct

SEQ ID NO: 7672 - DNA, 48 bp, Artificial Sequence; identical to SEQ ID NO: 3781
  Synthetic construct

SEQ ID NO: 7673 - DNA, 39 bp, Artificial Sequence; identical to SEQ ID NO: 3782
  Synthetic construct

SEQ ID NO: 7674 - DNA, 72 bp, Artificial Sequence; identical to SEQ ID NO: 3783
  Synthetic construct

SEQ ID NO: 7675 - DNA, 66 bp, Artificial Sequence; identical to SEQ ID NO: 3784
  Synthetic construct

SEQ ID NO: 7676 - DNA, 45 bp, Artificial Sequence; identical to SEQ ID NO: 3785
  Synthetic construct

SEQ ID NO: 7677 - DNA, 48 bp, Artificial Sequence; identical to SEQ ID NO: 3786
  Synthetic construct

SEQ ID NO: 7678 - DNA, 66 bp, Artificial Sequence; identical to SEQ ID NO: 3787
  Synthetic construct

SEQ ID NO: 7679 - DNA, 51 bp, Artificial Sequence; identical to SEQ ID NO: 3788
  Synthetic construct

SEQ ID NO: 7680 - DNA, 57 bp, Artificial Sequence; identical to SEQ ID NO: 3789
  Synthetic construct

SEQ ID NO: 7681 - DNA, 51 bp, Artificial Sequence; identical to SEQ ID NO: 3790
  Synthetic construct

SEQ ID NO: 7682 - DNA, 54 bp, Artificial Sequence; identical to SEQ ID NO: 3791
  Synthetic construct

SEQ ID NO: 7683 - DNA, 42 bp, Artificial Sequence; identical to SEQ ID NO: 3792
  Synthetic construct

SEQ ID NO: 7684 - DNA, 69 bp, Artificial Sequence; identical to SEQ ID NO: 3793
  Synthetic construct

SEQ ID NO: 7685 - DNA, 63 bp, Artificial Sequence; identical to SEQ ID NO: 3794
  Synthetic construct

SEQ ID NO: 7686 - DNA, 45 bp, Artificial Sequence; identical to SEQ ID NO: 3795
  Synthetic construct

SEQ ID NO: 7687 - DNA, 60 bp, Artificial Sequence; identical to SEQ ID NO: 3796
  Synthetic construct

SEQ ID NO: 7688 - DNA, 45 bp, Artificial Sequence; identical to SEQ ID NO: 3797
  Synthetic construct

SEQ ID NO: 7689 - DNA, 57 bp, Artificial Sequence; identical to SEQ ID NO: 3798
  Synthetic construct

SEQ ID NO: 7690 - DNA, 36 bp, Artificial Sequence; identical to SEQ ID NO: 3799
  Synthetic construct

SEQ ID NO: 7691 - DNA, 60 bp, Artificial Sequence; identical to SEQ ID NO: 3800
  Synthetic construct

SEQ ID NO: 7692 - DNA, 48 bp, Artificial Sequence; identical to SEQ ID NO: 3801
  Synthetic construct

SEQ ID NO: 7693 - DNA, 51 bp, Artificial Sequence; identical to SEQ ID NO: 3802
  Synthetic construct

SEQ ID NO: 7694 - DNA, 36 bp, Artificial Sequence; identical to SEQ ID NO: 3803
  Synthetic construct

SEQ ID NO: 7695 - DNA, 63 bp, Artificial Sequence; identical to SEQ ID NO: 3804
  Synthetic construct

SEQ ID NO: 7696 - DNA, 39 bp, Artificial Sequence; identical to SEQ ID NO: 3805
  Synthetic construct

SEQ ID NO: 7697 - DNA, 57 bp, Artificial Sequence; identical to SEQ ID NO: 3806
  Synthetic construct

SEQ ID NO: 7698 - DNA, 48 bp, Artificial Sequence; identical to SEQ ID NO: 3807
  Synthetic construct

SEQ ID NO: 7699 - DNA, 39 bp, Artificial Sequence; identical to SEQ ID NO: 3808
  Synthetic construct

SEQ ID NO: 7700 - DNA, 54 bp, Artificial Sequence; identical to SEQ ID NO: 3809
  Synthetic construct

SEQ ID NO: 7701 - DNA, 42 bp, Artificial Sequence; identical to SEQ ID NO: 3810
  Synthetic construct

SEQ ID NO: 7702 - DNA, 48 bp, Artificial Sequence; identical to SEQ ID NO: 3811
  Synthetic construct

SEQ ID NO: 7703 - DNA, 63 bp, Artificial Sequence; identical to SEQ ID NO: 3812
  Synthetic construct

SEQ ID NO: 7704 - DNA, 42 bp, Artificial Sequence; identical to SEQ ID NO: 3813
  Synthetic construct

SEQ ID NO: 7705 - DNA, 54 bp, Artificial Sequence; identical to SEQ ID NO: 3814
  Synthetic construct

SEQ ID NO: 7706 - DNA, 48 bp, Artificial Sequence; identical to SEQ ID NO: 3815
  Synthetic construct

SEQ ID NO: 7707 - DNA, 51 bp, Artificial Sequence; identical to SEQ ID NO: 3816
  Synthetic construct

SEQ ID NO: 7708 - DNA, 69 bp, Artificial Sequence; identical to SEQ ID NO: 3817
  Synthetic construct

SEQ ID NO: 7709 - DNA, 51 bp, Artificial Sequence; identical to SEQ ID NO: 3818
  Synthetic construct

SEQ ID NO: 7710 - DNA, 69 bp, Artificial Sequence; identical to SEQ ID NO: 3819
  Synthetic construct

SEQ ID NO: 7711 - DNA, 66 bp, Artificial Sequence; identical to SEQ ID NO: 3820
  Synthetic construct

SEQ ID NO: 7712 - DNA, 54 bp, Artificial Sequence; identical to SEQ ID NO: 3821
  Synthetic construct

SEQ ID NO: 7713 - DNA, 57 bp, Artificial Sequence; identical to SEQ ID NO: 3822
  Synthetic construct

SEQ ID NO: 7714 - DNA, 51 bp, Artificial Sequence; identical to SEQ ID NO: 3823
  Synthetic construct

SEQ ID NO: 7715 - DNA, 42 bp, Artificial Sequence; identical to SEQ ID NO: 3824
  Synthetic construct

SEQ ID NO: 7716 - DNA, 51 bp, Artificial Sequence; identical to SEQ ID NO: 3825
  Synthetic construct

SEQ ID NO: 7717 - DNA, 48 bp, Artificial Sequence; identical to SEQ ID NO: 3826
  Synthetic construct

SEQ ID NO: 7718 - DNA, 48 bp, Artificial Sequence; identical to SEQ ID NO: 3828
  Synthetic construct

SEQ ID NO: 7719 - DNA, 24 bp, Artificial Sequence
  Synthetic construct
tgtacgagaagtgatagacactgg

SEQ ID NO: 7720 - DNA, 60 bp, Artificial Sequence; identical to SEQ ID NO: 3830
  Synthetic construct

SEQ ID NO: 7721 - DNA, 48 bp, Artificial Sequence; identical to SEQ ID NO: 3831
  Synthetic construct

SEQ ID NO: 7722 - DNA, 75 bp, Artificial Sequence; identical to SEQ ID NO: 3832
  Synthetic construct

SEQ ID NO: 7723 - DNA, 45 bp, Artificial Sequence; identical to SEQ ID NO: 3833
  Synthetic construct

SEQ ID NO: 7724 - DNA, 60 bp, Artificial Sequence; identical to SEQ ID NO: 3834
  Synthetic construct

SEQ ID NO: 7725 - DNA, 69 bp, Artificial Sequence; identical to SEQ ID NO: 3835
  Synthetic construct

SEQ ID NO: 7726 - DNA, 54 bp, Artificial Sequence; identical to SEQ ID NO: 3836
  Synthetic construct

SEQ ID NO: 7727 - DNA, 48 bp, Artificial Sequence; identical to SEQ ID NO: 3837
  Synthetic construct

SEQ ID NO: 7728 - DNA, 57 bp, Artificial Sequence; identical to SEQ ID NO: 3838
  Synthetic construct

SEQ ID NO: 7729 - DNA, 36 bp, Artificial Sequence; identical to SEQ ID NO: 3839
  Synthetic construct

SEQ ID NO: 7730 - DNA, 45 bp, Artificial Sequence; identical to SEQ ID NO: 3840
  Synthetic construct

SEQ ID NO: 7731 - DNA, 54 bp, Artificial Sequence; identical to SEQ ID NO: 3841
  Synthetic construct

SEQ ID NO: 7732 - DNA, 63 bp, Artificial Sequence; identical to SEQ ID NO: 3842
  Synthetic construct

SEQ ID NO: 7733 - DNA, 51 bp, Artificial Sequence; identical to SEQ ID NO: 3843
  Synthetic construct

SEQ ID NO: 7734 - DNA, 51 bp, Artificial Sequence; identical to SEQ ID NO: 3844
  Synthetic construct

SEQ ID NO: 7735 - DNA, 51 bp, Artificial Sequence; identical to SEQ ID NO: 3845
  Synthetic construct

SEQ ID NO: 7736 - DNA, 63 bp, Artificial Sequence; identical to SEQ ID NO: 3846
  Synthetic construct

SEQ ID NO: 7737 - DNA, 63 bp, Artificial Sequence; identical to SEQ ID NO: 3847
  Synthetic construct

SEQ ID NO: 7738 - DNA, 42 bp, Artificial Sequence; identical to SEQ ID NO: 3848
  Synthetic construct

SEQ ID NO: 7739 - DNA, 69 bp, Artificial Sequence; identical to SEQ ID NO: 3849
  Synthetic construct

SEQ ID NO: 7740 - DNA, 48 bp, Artificial Sequence; identical to SEQ ID NO: 3850
  Synthetic construct

SEQ ID NO: 7741 - DNA, 45 bp, Artificial Sequence; identical to SEQ ID NO: 3851
  Synthetic construct

SEQ ID NO: 7742 - DNA, 66 bp, Artificial Sequence; identical to SEQ ID NO: 3852
  Synthetic construct

SEQ ID NO: 7743 - DNA, 57 bp, Artificial Sequence; identical to SEQ ID NO: 3853
  Synthetic construct

SEQ ID NO: 7744 - DNA, 63 bp, Artificial Sequence; identical to SEQ ID NO: 3854
  Synthetic construct

SEQ ID NO: 7745 - DNA, 54 bp, Artificial Sequence; identical to SEQ ID NO: 3855
  Synthetic construct

SEQ ID NO: 7746 - DNA, 45 bp, Artificial Sequence; identical to SEQ ID NO: 3856
  Synthetic construct

SEQ ID NO: 7747 - DNA, 54 bp, Artificial Sequence; identical to SEQ ID NO: 3857
  Synthetic construct

SEQ ID NO: 7748 - DNA, 60 bp, Artificial Sequence; identical to SEQ ID NO: 3858
  Synthetic construct

SEQ ID NO: 7749 - DNA, 57 bp, Artificial Sequence; identical to SEQ ID NO: 3859
  Synthetic construct

SEQ ID NO: 7750 - DNA, 48 bp, Artificial Sequence; identical to SEQ ID NO: 3860
  Synthetic construct

SEQ ID NO: 7751 - DNA, 48 bp, Artificial Sequence; identical to SEQ ID NO: 3861
  Synthetic construct

SEQ ID NO: 7752 - DNA, 39 bp, Artificial Sequence; identical to SEQ ID NO: 3862
  Synthetic construct

SEQ ID NO: 7753 - DNA, 72 bp, Artificial Sequence; identical to SEQ ID NO: 3863
  Synthetic construct

SEQ ID NO: 7754 - DNA, 60 bp, Artificial Sequence; identical to SEQ ID NO: 3864
  Synthetic construct

SEQ ID NO: 7755 - DNA, 54 bp, Artificial Sequence; identical to SEQ ID NO: 3865
  Synthetic construct

SEQ ID NO: 7756 - DNA, 42 bp, Artificial Sequence; identical to SEQ ID NO: 3866
  Synthetic construct

SEQ ID NO: 7757 - DNA, 51 bp, Artificial Sequence; identical to SEQ ID NO: 3867
  Synthetic construct

SEQ ID NO: 7758 - DNA, 54 bp, Artificial Sequence; identical to SEQ ID NO: 3868
  Synthetic construct

SEQ ID NO: 7759 - DNA, 39 bp, Artificial Sequence; identical to SEQ ID NO: 3869
  Synthetic construct

SEQ ID NO: 7760 - DNA, 51 bp, Artificial Sequence; identical to SEQ ID NO: 3870
  Synthetic construct

SEQ ID NO: 7761 - DNA, 66 bp, Artificial Sequence; identical to SEQ ID NO: 1774
  Synthetic construct

SEQ ID NO: 7762 - DNA, 57 bp, Artificial Sequence; identical to SEQ ID NO: 3872
  Synthetic construct

SEQ ID NO: 7763 - DNA, 54 bp, Artificial Sequence; identical to SEQ ID NO: 3873
  Synthetic construct

SEQ ID NO: 7764 - DNA, 51 bp, Artificial Sequence; identical to SEQ ID NO: 3874
  Synthetic construct

SEQ ID NO: 7765 - DNA, 57 bp, Artificial Sequence; identical to SEQ ID NO: 3875
  Synthetic construct

SEQ ID NO: 7766 - DNA, 51 bp, Artificial Sequence; identical to SEQ ID NO: 3876
  Synthetic construct

SEQ ID NO: 7767 - DNA, 45 bp, Artificial Sequence; identical to SEQ ID NO: 3877
  Synthetic construct

SEQ ID NO: 7768 - DNA, 51 bp, Artificial Sequence; identical to SEQ ID NO: 3878
  Synthetic construct

SEQ ID NO: 7769 - DNA, 51 bp, Artificial Sequence; identical to SEQ ID NO: 3879
  Synthetic construct

SEQ ID NO: 7770 - DNA, 48 bp, Artificial Sequence; identical to SEQ ID NO: 3880
  Synthetic construct

SEQ ID NO: 7771 - DNA, 328 bp, Artificial Sequence
  Synthetic construct
gaaattgtgttgacgcagtctccagacaccctgtctttgtttccaggggaaagagccaccctctcctgcagggccagtcagagtgttagcagcaggtacttagcctggtaccagcagaaacctggccaggctcccaggctcctcatctatggtgcatccagtagggccactggcaccccagacaggttcagtggcagtgggtctgggacagacttcactctcaccatcagcagactggagcctgaagattttgcagtgtattactgtcagcagtatggtaggtcaccccagatcaccttcggccaagggacacgactggaaagtaaac

SEQ ID NO: 7772 - DNA, 322 bp, Artificial Sequence
  Synthetic construct
gacatccagatgacccagtctccttccaccctgtctgcttctgttggagacagagtcatcattacttgccgggccagtgagggtataagtaactacttggcctggtatcagcaaaaaccagggaaagcccctaacctcctcatctataaggcgtctactttagagaatggggtcccctcacggttcagcggcagtggatttgggacagaattcactctcgccatcagcagcctgcaccctgatgattttgcaacttattactgccaacaatataagagtttttcttatacttttggccaggggaccaagctggacatgaaac

SEQ ID NO: 7773 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggttccaacatcacccaggcaaagcccccaaactcataatttatgaggtcagtaatcggccctcgggggtttctagtcgcttctctggctccaagtctggcaacacggcctccctgaccatctctgggctccaggctgaggacgaggctgattattactgcagctcatacagaagcagcaggattctttatgtcttcggaactgggaccaaggtcaccgtcctag

SEQ ID NO: 7774 - DNA, 322 bp, Artificial Sequence
  Synthetic construct
gacatccagatgacccagtctccatcctccctgtctgcatctgtcggagacagagtcaccatcacttgccgggcgagtgatgatcttgacaatcatttagcctggtatcagcagagatcagggaaagcccctaagcttctgctgtatggtgttaccagattgaaaagtggggtcccatcccgattcagtggcagtggatctgggacggattacagcctcaccatcgatagcctgcagcctgaagattttgcaacatatttctgtcagcaatatcatatgacccctccgacgttcggccaagggaccaaggtggacatcaaac

SEQ ID NO: 7775 - DNA, 322 bp, Artificial Sequence
  Synthetic construct
gaaaatgtgttgacgcagtttccaggcaccctgtctttgtctccaggggaaagagccaccctctcctgcagggccagtcagggtgttcacagcaacactgtagcctggtaccagcagaaacctggccagcctcccagactcctcatctctggtgcatccagcagggccactggcgttccagataggttcagtgccagtgggtctgggacagagttcagtctcactatcagcagactggagcctgaagattttgcagtgtattactgtcagcagtttggcagctcacccactttcggccctgggaccagagtggatatcaaac

SEQ ID NO: 7776 - DNA, 331 bp, Artificial Sequence
  Synthetic construct
gaaattgtgttgacgcagtctccaggcaccctgtctttgtctccaggggaaagagccaccctctcctgcagggccaggcagagtcttagcaacacctcgttagcctggtaccagcagaaacctggccaggctcccaggctcctcatctatggtgcatccaggagggccactggcgtcccagacaggttcagtggcagtgggtctgggacagagttcactctctccatcgccggactggagcctgaagattttggagtgtattactgtcagcattatggtacctcacctccgatgtacacctttggccaggggaccaacctggaaatcaaac

SEQ ID NO: 7777 - DNA, 328 bp, Artificial Sequence
  Synthetic construct
caggctgtggtgactcaggagccctcactgactgtgtccccaggggggacagtcactctcacctgtggctccagcactggagctgtcaccagtggtcattatccctactggttccagcagaagcctggccaagcccccaggacactgatttatgatacaagcaacagacactcctggacacctgcccggttctcaggctccctccttgggggcgaagctgccctgaccctttcgggtgcgcagcctgaggatgaggctgactattactgcttgctctcccatagtggtgcttgggtgttcggcggagggaccacgctgaccgtcctag

SEQ ID NO: 7778 - DNA, 331 bp, Artificial Sequence
  Synthetic construct
caatctgccctgactcagcctcgctcagtgtccgggtctcttggacagtcagtcaccatctcctgcactggaaccagccgtgatgttggtgttcataagtctgtcgcctggtaccaacaacaccctgataaagcccccaaggtcataatttttgaagacagtaagaggccctcaggtgtccctgatcgcttctctgcctccaggtctggcaacacggcctccctgaccatctctgggctccaggctgacgatgaggctgtctatttttgttcctcatatgcaggctcttacacttgggtgttcggcggagggaccgacctgaccgtcctgg

SEQ ID NO: 7779 - DNA, 325 bp, Artificial Sequence
  Synthetic construct
gaaattgtgttgacgcagtctccaggcaccctgtctgtgtctccaggggaaagagtcaccctctcctgcagggccagtcagagtgttagcagcaattacttagcctggtatcagcagacacctggccaggctcccaggctccttatatatggttcatctatcagggccactggcgtcccagacaggttcagtggcagtgggtctgggacagacttcactctcaccatcagcagactggagcctgaagattttgcagtgtattactgtcagcagtatgatggctcacctcagacgttcggccaagggaccaaggtggaaatcaaac

SEQ ID NO: 7780 - DNA, 322 bp, Artificial Sequence
  Synthetic construct
gacatccagatgacccagtctccttccaccctgtctccatctgtaggagacagagtcaccatcacttgccgggccagtcagagtgttagtacctggttggcctggtatcagcagaaaccagggaaagccccgaggatcttgatctataagacgtctagtttagagagtggggtcccatcaaggttcagcggcagtggatctggaacagagttcactctcactatcagtagcctgcagcctgatgattttgcaacttattactgccaacagtatgatagttttccatacacttttggcccggggaccaagctggagatcaaac

SEQ ID NO: 7781 - DNA, 337 bp, Artificial Sequence
  Synthetic construct
cagtctgccctgactcagcctgcctccgtgtctgggtctcctggacagtcgatcaccatctcctgcactggaaccagcagtgacgttggtggttataaatatgtctcctggtaccaacagcacccaggcaaagcccccaaactcataatttatgaggtcagtaatcggccctcaggggtttccaatcgcttctctggctccaagtctggcaacacggcctccctgaccatctctggcctccaggctgaagacgaggctgattactactgcagctcatatacaaacaacaacactcctcgttgggtgttcggcggagggaccaagctgaccgtcctcg

SEQ ID NO: 7782 - DNA, 340 bp, Artificial Sequence
  Synthetic construct
gacatcgttatgacccagtctccagacttcctggctgtgtctctgggcgagagggccaccatcaactgcaagtccagccagagtgttttatacagctccaacaataagacctacttatcttggttccagcagaagccaggacagcctcctaagttgctcatttactgggcatctacccgggaatccggggtccccgaccgattcagtggcagcggctctgagacagatttcactctcaccatcagcggcctgcaggctgaagatgtggcagtttattactgtcagcaatattttgttcctcccctcactttcggccctgggaccaaagtgggtatcaaac

SEQ ID NO: 7783 - DNA, 325 bp, Artificial Sequence
  Synthetic construct
tccgatgaattgacacagccaccctcgatgtcagtgtcactaggacaaacggccaggatcacctgctctggagatggattgccaaaacaatatgtttattggtaccaacagaagccaggccaggcccctgaattggtgatgtttaaagacaaccagaggccttcaaatatccctgagcgattctctggttccagctcagggacaatagtcacgttgaccattagtggagtccaggcagaagacgaggctgactattactgtcaatcaacagacagtagtggtgattattggctgttcggcggagggacccacctggccgtcctgg

SEQ ID NO: 7784 - DNA, 106 bp, Artificial Sequence
  Synthetic construct
atctctgggctccaggctgacgacgaggctgattattactgcacctcatatacaaacaacagcaattctcaggtattcggcggagggaccaagctgaccgtcctag

SEQ ID NO: 7785 - DNA, 319 bp, Artificial Sequence
  Synthetic construct
gaacttgtcttgacacagtctccagccaccctgtctttgtctccaggggaaagagccaccctctcctgcagggccagtcagactctttacacccacttagcctggtaccaacacaagcctggccaggctcccagactcctcatctatgatgcttcccacagggccactggcatcccagccaggttcagtggcagtgggtctgggacagacttcactctcaccatcaacagcctggagcctgaagattctgcagtttattactgtcagcagcgcagcaactggatcaccttcggccaagggacacgactggagattaaac

SEQ ID NO: 7786 - DNA, 334 bp, Artificial Sequence
  Synthetic construct
gacatcgtgatgacccagtccccagactccctgactgtgtctctgggcgagagggccaccatcaactgcaagtccagccagaatgttttatacgacaataagaactacttaacttggtaccaacagaagccagggcagcctcctaagaaactcatttcctgggcatctacccgggaatccggggtccctgaccgattcagtggcagcgggtctgggacagatttcactctcaccatcaacagcctgcagtctgaagatgtggcagtttattactgtcagcaatattatagtactcctcccacgttcggccaagggaccaaggtggaaatcaaac

SEQ ID NO: 7787 - DNA, 325 bp, Artificial Sequence
  Synthetic construct
gaaattgtgctgacgcagtctccaggcaccctgtctttgtctccaggggaaagagccaccctctcctgcagggccagtcagagtgttagcagcacctacttagcctggtaccagcagaaacctggccaggctcccacgctcctcatttatggtgcatccaccagggccactggcatccccgacaggttcagtggcagtgggtctgggacagacttcactctcaccgtcagcagactggagcctgaagattttgcagtctattactgtcagcagtatggtccctcactttgcaccttcggccaagggacacgactggagattaaac

SEQ ID NO: 7788 - DNA, 334 bp, Artificial Sequence
  Synthetic construct
gctgatccttggtctcctgctcctcaggctcaccagggcccagcactgactcactggcatgtatttctccctctttgcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcagatattcggcggagggaccaagctgaccgtcctag

SEQ ID NO: 7789 - DNA, 340 bp, Artificial Sequence
  Synthetic construct
gacatcgtgatgacccagtctccagactccctggctgtgtctctgggcgagcgggccaccatctcctgcaagtccagccagagtgttttatacaggtccaagaatcagaactacttagcttggtaccagcagaaaccaggacagcctcctaaactgctcactaaatgggcttctacccgggagtccggggtccctgaccgattcagtggcagcgggtctgggacagatttcaatctcaccatcagcagcctgcaggctgaagatgtggcagtttattactgtcagcaatattatagtgctcctttcactttcggccctgggaccaaagtgggtgtcaaac

SEQ ID NO: 7790 - DNA, 334 bp, Artificial Sequence
  Synthetic construct
cagtctgtgctgacgcagccgccctcagtgtctggggccccaggccagagggtcaccatctcctgcactgggagcagctccaacatcggggcaggttatgatgtacactggtaccagcagcttccaggaacagcccccaaactcctcatctatggtaacaggattcggccctcaggggtccctgaccgattctcaggctccaagtctggcacctcagcctccctggccatcagtgggctccaggctgaggatgaggctgattattactgccagtcctatgacagcaggctgactacttgggtgttcggcggagggaccaggctgaccgtcccag

SEQ ID NO: 7791 - DNA, 331 bp, Artificial Sequence
  Synthetic construct
cagtctgccctgactcagcctccctccgcgtccgggtctcttggacagtcagtcaccatctcctgcactggaaccagcagtgacgtcggtggttataactatgtctcctggtaccaacaacacccaggcaaagcccccaaactcatgatttctgaggtcaataagcggccctctggggtccctgatcgcttctctggctccaagtctggcaacacggcctccctgaccgtctctgggctccaggctgaggatgaggctgattattattgcagctcatatgcaggcaacaacaattatctcttcggaactgggaccaaggtcaccgtcctag

SEQ ID NO: 7792 - DNA, 340 bp, Artificial Sequence
  Synthetic construct
gacatcgtgatgacccagtctccagactccctggctgtgtctctgggcgagagggccaccatcaactgcaagtccagccagagtgttttatacacctccaacaatgagcactacttagcttggtaccagcagaaaccagggcagcctcctaagttgctcatttactgggcatctgtccgggaatccggggtccctgaccgattcagtggcgccgggtctgggacagatttcaccctcactatcagcagcctgcaggctgaagatgtggcagtttattactgtcagcaatattatacttctacgtggacgttcggccaagggaccaaggtggaagtcaaac

SEQ ID NO: 7793 - DNA, 325 bp, Artificial Sequence
  Synthetic construct
tcttctgagctgactcaggaccctgctgtgtctgtggccttgggacagacagtcaagatcacatgccaaggagacagcctcagaaaccattattcaagctggttccagcagaagccaggacaggcccctgttcttgtcatctttggtgaaaacaagcggccctcagggatcccagaccgattctctgcctccaggtcaggagacacagcttccttgaccatcagtggggctcaggcggaagatgaggctgactattactgtaattcccgcgacagcagtggtgaccgttatgtcttcggctctgggaccaaggtcaccgtcctag

SEQ ID NO: 7794 - DNA, 334 bp, Artificial Sequence
  Synthetic construct
aattttatactgactcagccccactctgtgtcggagtctccggggaagacggtcatcatctcctgcacccgcagcagtggcagtattggcagcaactttgtgcagtggtaccagcagcgcccgggcagtgcccccaccactgtgatctatgcagataaccaaagaccctctggggtccctgctcggttctctggctccatcgacaggtcctccaactctgcctccctcatcatctctggtctgagcactgaggacgaggctgactactattgtcactcttatgatagcgccaatccagggatattcggcggtgggaccagggtgaccgtcctca

SEQ ID NO: 7795 - DNA, 340 bp, Artificial Sequence
  Synthetic construct
gacatcgtgatgacccaatctccaggctccctggctgtctctctgggcgagagggccacaataacctgcaagtccagccagagtcttttatatagcgccaccgagaggacctacctagcttggtaccagcagaagccaagacagcctcctaagttactcatcacctgggcatcgacccgggaatccggggtccctgaccgcttcagtggcagcgggtctgagacggatttcactctcaccatcagcagcctgcagcctgaggatgtggcaatttatttctgtctacaacattattctactcctcagacttttggccaggggaccaaggtggagattaacc

SEQ ID NO: 7796 - DNA, 322 bp, Artificial Sequence
  Synthetic construct
gaaattgtgctgactcagtctccgggctttcagtatgtgactccaaaggagaaagtcaccgtcacctgccgggccagtcagaacatcgagactgccttacactggtaccagcacaaaccagatcagtctccaaaactgctcatcaagtatgcttcccagtccatttcaggggtcccctcgaggttcagtggcagtggatccgggacagatttcaccctcaccatcaatggcctggaacctgaagatgctgcaacgtattactgccatcagagtagtgccttaattcaaacttttggccaggggaccaagctggagatcaaac

SEQ ID NO: 7797 - DNA, 325 bp, Artificial Sequence
  Synthetic construct
gaaattgtgttgacgcagtctccaggcaccctgtctttgtctccaggggaaagagccaccctctcctgcagggccagtcagcctgttaccagcggctacttagcctggtaccagcagaaacctggccaggctcccacgctcctcatctacggtgcatccacaagggccgctggcatcgcagacaggttcagtggcagtggctctgggacagacttcactctcaccatcagcagactggagcctgaagattttgcagtgtattactgtcagcactatggtagctcattgtggacgttcggccaagggtccaaggtggaaatcaaac

SEQ ID NO: 7798 - DNA, 331 bp, Artificial Sequence
  Synthetic construct
gaaattgtgttgacgcagtctcctggcaccctgtctttgtctccaggggaaagagccaccctctcctgcagggccagtcggagtgttaccagcgactacttagcctggtaccagcagaaacctggccaggctcccaggctcctcatctatggtatatccaccagggccactggcatcccagacaggttcagtggcagtgggtctgggacagacttcactctcaccattaacagactggagcctgaagattctgcagtatattactgtcagcagtatggcagctcacctcccccgtacacttttggccaggggaccaagctggagatcaaac

SEQ ID NO: 7799 - DNA, 322 bp, Artificial Sequence
  Synthetic construct
gaaattgtgttgacgcagtctccaggcaccctgtctttgtctccaggggaaagagccaccctctcctgcagggccagtcagagtgtgagcagcacctacttagcctggtaccagcagaaacctggccagcctcccaggctcctcatctatagtgcatccagcagggccactggcttcccagacaggttcagtggcagtgggtctgggacagacttcactctcaccatcagcagactggagcctgaagattttgcagtgtatttctgtcagcagtatggtggctcacccactttcggcggagggaccaaggtggagatcaaac

SEQ ID NO: 7800 - DNA, 325 bp, Artificial Sequence
  Synthetic construct
gaaattgtgttgacgcagtctccaggcaccctgtctttgtctccaggggaaagagccaccctctcttgcagggccagtcagactgttagcagcaggtacttaagttggtatcagcagaaacgtggccaggctcccaggctcgtcatctatggtgcatcgagcagggccgctggcatcccagacaggttcagtggcagtggctctgggacagacttcactctcaccatcaccagactggagcctgacgattttgcaatgtattactgtcagcagtacggtagttcagtgtggacgttcggcccagggacccacctggagatcaacc

SEQ ID NO: 7801 - DNA, 325 bp, Artificial Sequence
  Synthetic construct
tcctatgtgttgactcagccaccctcggtgtcagtggccccaggacagacggccaccattacctgtgggggatacaactttgaaactacagatgtccactggtaccagcagaggccaggccaggcccctagactggtcgtcaaagatgatagcgaccggccctcagggatccccgagcgattctcaggctccaactctgggaacacggccaccttgaccatcaccacggtcgaggtcggggatgaggccgactattattgtcaggtgtgggatagcagtagtgatcatgtggcattcggcggagggaccaagttgaccgtcctag

SEQ ID NO: 7802 - DNA, 334 bp, Artificial Sequence
  Synthetic construct
cagtctgtgctgactcagccaccctcagcgtctgggacccccgggcagagggtctccatctcttgttctggagccagctccaacatcggaagtaatgttgtcaactggtaccagcagctcccaggagcggcccccaagctcctcatctatggtaacaatcagcggccctcaggggtccctgaccgattctctggctccaagtctggcacctcagcctccctggccatcagtgggctccagtctgaggatgaggctgattattactgttcagcatgggatgaaagtctgaatggtcatgtgatattcggcggggggacaaagttgaccgtcctag

SEQ ID NO: 7803 - DNA, 319 bp, Artificial Sequence
  Synthetic construct
gacatccagatgacccagtctccatcctccctgtctgcatctattggagacagagtcaccctcacttgtcgggcaagtcagaatattggcaggtatttaaattggtatcagcaaaaaccaggaaaagcccccttgctcctgatctatgctgcagtcagtttgcaaagtggggtcccttcacggttcagtggcagtgggtctgggacagatttcactctcaccatcagcagactgcaatctgaggattttgcaacttacttctgtcaacagagcttcagtagtgtcaccttcggcggagggaccaaggtggagatcaaac

SEQ ID NO: 7804 - DNA, 334 bp, Artificial Sequence
  Synthetic construct
ctgtctgccctgactcagcctgcctccgtgtctgggtctcctggacagccgatcaccatctcctgcactggaagcagcggtgatgttgtaaattatgtccttgtctcccgctaccagcagcacccaggcaaagcccccaaagtcatgatttatgagggcagtaagcggccctcaggggtttctaatcgcttctctggctccaagtctggcaacacggcctccctgacaatctctgggctccaggctgaggacgaggctgattgtcactgctgctcaaatgcaggttgtaggacttggggtgtcttcggaactgggaccgaggtcaccgtcctag

SEQ ID NO: 7805 - DNA, 337 bp, Artificial Sequence
  Synthetic construct
gaaattgtgatgacccagactccactctctctgtccgtcacccctggacagccggcctccatctcctgcaagtctagtgagagtctcctgtatagtgatggaaagacttatttctattggtacctgcagaagccaggccagtctccacagctcctaatctatgaagtttccagccgggtctctggagtgccagataggttcagtggcaccgggtcagggacagatttcacactgaaaatcagccgggtggaggctgaggatgttgggatttattactgcatgcaaggtatataccttccgctcactttcggcggagggaccaaggtggagatcaaac

SEQ ID NO: 7806 - DNA, 322 bp, Artificial Sequence
  Synthetic construct
gccatccagttgacccagtctccatcctccctgtctgcgtctgtaggagacagagccaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagatttcactctcaccatcagcagcctgcagcctgaagattttgcaacttattattgtcaacagcttaatagtaacccattcactttcggccctgggaccaaagtggatatcaaac

SEQ ID NO: 7807 - DNA, 91 bp, Artificial Sequence
  Synthetic construct
gcagaagacgaggctgactattactgtcaatcaacagacagtagtggtgattattggctgttcggcggagggacccacctggccgtcctgg

SEQ ID NO: 7808 - DNA, 319 bp, Artificial Sequence
  Synthetic construct
gccatccggatgacccagtctccatcctcactctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagtggcagtggatctgggacagatttcactctcaccatcagctgcctgcagtctgaagattttgcaacttattactgtcaacagtattatagttacccctttttcggcggagggaccaaggtggagatcaaac

SEQ ID NO: 7809 - DNA, 322 bp, Artificial Sequence
  Synthetic construct
gccatccggatgacccagtctccatcctcactctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagtggcagtggatctgggacagatttcactctcaccatcagctgcctgcagtctgaagattttgcaacttattactgtcaacagtattatagttacccgtggacgttcggccaagggaccaaggtggaaatcaaac

SEQ ID NO: 7810 - DNA, 322 bp, Artificial Sequence
  Synthetic construct
tccgacgagttgacacagccaccctcggtgtcagtgtccccaggacagacggccaggatcgcctgctctggagatgcattgccaggcaattatgcttattggtaccaacagaagccaggccaggcccctgtattggtgatatataaagacgatgtgaggccctcagggatccctgagcgattctctgcctccaagtcaggggcaacggtcacgttgaccatcaggggagtccaggcagaagacgagggtgactattattgtcagtcatcagacagcagtggtaattttgtcttcggacttgggaccacggtcaccgtcctac

SEQ ID NO: 7811 - DNA, 334 bp, Artificial Sequence
  Synthetic construct
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgggtggtggggatgtcttcggaactgggaccaaggtcaccgtcctag

SEQ ID NO: 7812 - DNA, 328 bp, Artificial Sequence
  Synthetic construct
gacatccagatgacccagtctccttccaccctgtctgcatctgtaggagacagagtcaccatctcttgccgggccagtcagagtattagtagctggttggcctggtatcagcagaaacctgggaaagcccctaaactcctgatctataaggcgtctagtttagaaagtggggtcccgtcaaggttcagcggcagtggatctgggacagagttcactctcaccatcaacagcctgcagcctgatgattttgcaacttattactgcctacagtataatagttcttcttcaacatacacttttggccaggggaccaagctggagatcaaac

SEQ ID NO: 7813 - DNA, 331 bp, Artificial Sequence
  Synthetic construct
cagtctgccctgactcagcctgcctccgtatctgggtctgctggacagtcgatcaccatctcctgcactggatccagcagagatgttgggagttataaccttgtctcctggttccaacaacacccaggcaaagcccccaaactcattatttatgaggtcactgaacggccctctggggtttctaatcgcttctctggctccaagtctggcgacacggcctccctgacaatctctggtctccagactgacgacgaggcggattattattgctgctcgtatgcagggactagcactttcgtgttcggcggagggaccaaggtgaccgtcctag

SEQ ID NO: 7814 - DNA, 322 bp, Artificial Sequence
  Synthetic construct
gacatccagatgacccagtctccatcttccgtgtctgcatctgtaggagacagagtcacgatttcttgtcgggcgagtcagggaattagcatctggttagcctggtatcagcaaaaaccagggaaagcccctaaggtcctgatccatgctgcatccagtttgcaaagtgaggtcccgtcaaggttcagcggcagtggatctgggacagatttcactctcaccatcaacagcctgcagcctgaagattttgcaacttactattgtgaacaggctaacagtttcccgctcactttcggcggagggaccaaggtggagatcaaac

SEQ ID NO: 7815 - DNA, 349 bp, Artificial Sequence
  Synthetic construct
cagcctgtgctgactcagccaccttctgcatcagcctccctgggagcctcggtcacactcacctgcaccctgagcagcggctacagcacttataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaagaggaggatgaaggtgactatcactgtggggcagaccatgacagtgggagcaacttcgtttatgtcttcggaaatgggaccaaggtgatagtcctgg

SEQ ID NO: 7816 - DNA, 322 bp, Artificial Sequence
  Synthetic construct
gccatccaaatgacccagtctccatccttcctgtctgcatctgtaggagacagagtcaccctcacttgccgggccagtcaggacattgacaattatttagcctggtatcagcaaaaaccagggaaagcccctaaactcctgatctacgttgcatccactttgcagagtggggtcccatcaaggttcagcggcagtggatctgggacagaattcactctcacaatcagcagcctgcagcctgaagattttgcaacgtattactgtcaacaacttaatggttaccctccaacttttggcccggggaccaagctggagatcagag

SEQ ID NO: 7817 - DNA, 306 bp, Artificial Sequence
  Synthetic construct
gaaattgtgttgacgcagtctccaggcaccctgtctttgtctccaggggaaagagccaccctctcctgcagggccagtcagagtgtaagcagcagcttcttagcctggtaccagcagaaacctggccaggctcccaggctcctcatctatggtgcatccagcagggccactggcatcccagacaggttcagtggcagtgggtctgggacagacttcattctcaccatcagcagactggagcctgaagattttgcagtgtattgctgtcaccagtatagtacctcaccgtggacgttcggccgaggg

SEQ ID NO: 7818 - DNA, 340 bp, Artificial Sequence
  Synthetic construct
gacatcgtgatgacccagtctccagactccctggctgtgtctctgggcgagagggccaccatcaactgcaagtccagccagagtcttttatacagctccgacaaaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaccaatattataatattcctcgaacattcggccaagggaccaaggtggaaatcaaac

SEQ ID NO: 7819 - DNA, 337 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaccaatattatagtactctcactttcggcggagggaccaaggtggagatcaaac

SEQ ID NO: 7820 - DNA, 334 bp, Artificial Sequence
  Synthetic construct
gatgttgtgctgactcagtctccactctccctgcccgtcacccttggacagccggcctccatctcctgcatgtctagtcaaagcctcctacacagtgatggaaacacctacttgaattggtttcagcagaggccaggccaatctccaaggcgcctaatttataaggtttctaaccgggactctggggtcccagacagattcagcggcagtgggtcaggcactgatttcacactgacaatcagcagggtggaggctgaggatgttggcgtttattactgcatgcaaggtacacacctttacacctttggccaggggaccaagctggagatcaaac

SEQ ID NO: 7821 - DNA, 340 bp, Artificial Sequence; identical to SEQ ID NO: 1832
  Synthetic construct

SEQ ID NO: 7822 - DNA, 334 bp, Artificial Sequence
  Synthetic construct
caatctgccctgactcagcctgcctctgtgtctgggtctcctggacagtcgatcaccatctcctgcactggaaccagcagtgacgttggtacttttaagtatgtctcctggtaccaacaacacccgggcaaagcccccaaggtcctgatttatgaggtcagtcatcggccctcaggggtccctgatcgcttctctggctccaagtctggcaccacggcctccctgaccatctctgggctccaggctgcggacgaggctgattactattgcagctcatatagacgtgacatcgccctttatgtcttcggaaatgggaccagggtcgccgtcctcg

SEQ ID NO: 7823 - DNA, 334 bp, Artificial Sequence
  Synthetic construct
cagtctgccctgactcagcctgcctccgtgtctgggtctcctggacagtcgatcaccatctcctgcactgggagtacctcaaacatcggggcaggttatgatgtacactggttccagcagcttccagggacagcccccaaactcctcatttatggtatcaccagtcggccctcaggggtccctgaccgattctctggctccaagtctggcaacacggcctccctgaccatctctgggctccaggctgacgacgaggctgattattactgcacctcatatacaaacgacagcaattctcaggtattcggcggagggaccaagctgaccgtcctag

SEQ ID NO: 7824 - DNA, 334 bp, Artificial Sequence
  Synthetic construct
cagtctgccctgactcagcctgcctccgtgtctgggtctcctggacagtcgatcaccatctcctgcactggatccagcagtgatgttgggagttataaccttgtctcctggtaccaacaacacccaggcaaagcccccaaactcatgatttatgaggtcactaagcggccctcaggggtttctaatcgcttctctggctccaagtctggcaacacggcctccctgacaatctctgggctccgggctgaggacgaggctgattattcctgctgttcgtatgcaagtagtagcactttcgtgattttcggcggagggaccaagctgaccgtcctgg

SEQ ID NO: 7825 - DNA, 325 bp, Artificial Sequence
  Synthetic construct
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggagcacggccaccctgaccatcagcagggtcgaagccggggatgaggccgactattactgtcaggtgtgggatagtagtagtgatcattatgtcttcggaattgggaccaaggtcaccgtcctag

SEQ ID NO: 7826 - DNA, 325 bp, Artificial Sequence
  Synthetic construct
gagattgtgttgacacagtctccagccaccctgtctttgtctccaggggaaagagccaccctctcctgcagggccagtcagagtgttggcagctccttaaactggtaccaacaaaaacctggccaggctcccaggctcctcatctatgatgcatccagtagggccactggcatcccggccaggttcagtggcagtgggtctgggacagacttcactctcaccatcagcagcctggagcctgaagattttgcaatttattactgtcaccagcggagcagctggcctccgtacacttatggccaggggaccaagctggagatcaaac

SEQ ID NO: 7827 - DNA, 337 bp, Artificial Sequence
  Synthetic construct
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactatggggtcccagacagattcagcggcagtgggtcagacactgatttcacactgagaatcagcagggtggaggctgaggatgttggactttattactgcatgcagggtacacactggcctcggacgttcggccaagggaccaaggtggaaatcaaac

SEQ ID NO: 7828 - DNA, 322 bp, Artificial Sequence
  Synthetic construct
gaaatagtgatgacgcagtctccagccaccctgtctgtgtctccaggggaaagcgccaccctctcctgcagggccagtcggagtattagcaataccttagcctggtaccagcagaaacctggacaggctcccaggctcctcatctatggtgcatccacgagggccactggtaccacagccaggttcagtggcagtgggtctgggacagagttcactctcaccatcagcagcctgcagtctgaagattttgcagtttattactgtcagcaatataataactggccgtacacttttggccaggggaccaaggtggagatcaaac

SEQ ID NO: 7829 - DNA, 334 bp, Artificial Sequence
  Synthetic construct
cagttaatgctgactcaagcgccctctgcctctgcctcactgggagcctcacttaacctcaaatgcactctggacagtggacacgacacctacgccgtcgcttggcttcagcagcggccagggaagggccctcgattcttgatgacggttgatcctgacggcaattatcatcaggatgacgagttgtctgatcgcttctcaggctccttctctggggctgaccgctacctcaccatctccagcctccagcctgaggatgaggctgactattactgtcagacctgggacactggcgttcgcctgttcggcggagggaccaaggtgaccgtcctgg

SEQ ID NO: 7830 - DNA, 337 bp, Artificial Sequence
  Synthetic construct
cagtctgtgctgacgcagccgccctcagtgtctggggccccagggcagagggtcaccatctcctgcactgggagcagctccaacatcggggcaggttatgatgtacactggtaccagcaacttccaggaacagcccccaaactcctcatctatggtaacagcaatcggccctcaggggtccctgaccgattctctggctccaagtctggcacctcagttttcctggccatcactgggctccaggctgaggatgaggctgattattactgccagtcctatgacttcagcctgagtggttcggatgtcttcggaactgggaccaaggtcatcgtcctag

SEQ ID NO: 7831 - DNA, 325 bp, Artificial Sequence
  Synthetic construct
gaaattgtgttgacgcagtctccaggcaccctgtctttgtctccaggggaaagagccaccctctcctgcagggccagtccgcgtcttagcagcacctacttagcctggtatcagcagaaacatggccaggctcccaggctcctcatctatggtgtatccaccagggccactggcatcccagacaggttcagtggcagtgggtctggggcagacttcactctcaccatcagcagtctgcagcctgaggattttgcagtctattactgtcaacagtatggtacttcacctgtcacttttggccaggggaccaagctggagatcaaac

SEQ ID NO: 7832 - DNA, 325 bp, Artificial Sequence
  Synthetic construct
gaaattgtgttgacacagtctccagccaccctgtctttgtctccaggggaaagagtcaccctctcctgcagggccagtcagagtgttgacaagttcttagtctggtaccaacagaaacctggccaggctcccaggctcctcatctatgatgcatccaagagggccactggcatcccagccaggttcagtggcagtgggtctgggacagacttcactctcaccatcagcagcctagaacctgaggattttgcagtttattactgtgagcaacgtattagctggcctggaatcaccttcggccaagggacacggctggacattaaac

SEQ ID NO: 7833 - DNA, 325 bp, Artificial Sequence
  Synthetic construct
gaaattgtgttgacgcagtctccaggcaccctgtctttgtctcttggggaaagagccaccctctcctgcagggcccgtcagaatgttaattggcgctacctagcctggtaccaacaaaagcctggccaggctcccaggctcctcatctttcgtgcatccaacagggccgatggcatcccagacaggttcagtggcagtgggtctgggacagagtacactctcaccatcaccaggctggagcctgaagatgttgcggtatattattgtcagcagtacggttattcacggtggacattcggccaggggaccaaggtggaaatcaaac

SEQ ID NO: 7834 - DNA, 337 bp, Artificial Sequence
  Synthetic construct
gatgttgtgttgactcagtctccaccctccctgcccgtcgcccttggacagccggcctccatctcctgcaggtctagtcaaagcctcgttcacactgatggaaacacctacctgagttggtttcaccagaggccaggccgagctccagggcgcctaatttataaggtttctaaccgggactctggggtcccagacagattcagcggcagtgggtcagccactgattttacactgagaatcagcagcgtggaggctgaggatgttgggatttattactgcatgcaaggtacacactggcctccggggttcggccaagggaccaaggtggaaatcaaac

SEQ ID NO: 7835 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatgggccctcagggatttctaatcgcttctctggctccaagtctggcaacacggcctccctgaccatctctgggctccaggctgacgacgaggctgattattactgcacctcatatacaaacaacagcaattctcaggtattcggcggaggggccaagctgaccgtcctag

SEQ ID NO: 7836 - DNA, 331 bp, Artificial Sequence
  Synthetic construct
cagtctgccctgactcagcctgcctccgtgtctgggtctcctggacagtcgatcaccatctcctgcactggaaccaacagtgatgttgggagttataaccttgtctcctggtaccaaaaccacccaggcaaagcccccaaagtcttgatttatgagggcagtaagcggccctcaggggtttctaatcgcttctctggctccaagtctggcaacacggcctccctgacaatctctgggctccaggctgaggacgaggttgattattactgctgctcatatgcagctagtagagttaaggtgttcggcggaggggccaagctgaccgtcctag

SEQ ID NO: 7837 - DNA, 340 bp, Artificial Sequence
  Synthetic construct
gacttcgtgctgacccagtctccagagtccctggctgtgtctctgggcgagagggccaccatcaactgcaagtccagcccgagtgtcttgtacacctccgacaaaaagaactacttagcttggtaccagcagaagccagggcggccacctaagttactcatttactgggcatctacacgggaatccggggtccctgaccgattcattggcagcgggtctgggacagatttcactctcaccatcaccagcctgcaggctgaagatgtggcagtttattactgtcaccaatattatactcctccattcactttcggccctgggaccaaagtggagatcaaac

SEQ ID NO: 7838 - DNA, 325 bp, Artificial Sequence
  Synthetic construct
gaaattgtgttgacccagtctccagccaccctgtctttgtctccaggggaaagagccgccctctcctgcagggccagtcagagtattagcacctccttagcctggtaccaacagaaacctggccaggctcccaggctcctcatctatgatacatccaacagggtcactggcatcccagccaggttcagtggcagtgggtctgggacagacttcactctcaccatcagcagcctagagcctgaagattttgcagtttattactgtctccaccgtaacaactggcctcccttcactttcggccctgggaccaaagtggaaatcaaac

SEQ ID NO: 7839 - DNA, 331 bp, Artificial Sequence
  Synthetic construct
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgaccctttcgggtgcgcagcctgaggatgaggctgagtattactgcttgctctcctatagtggtgctcattatgtcttcggaactgggaccaaggtcaccgtcctag

SEQ ID NO: 7840 - DNA, 322 bp, Artificial Sequence
  Synthetic construct
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgttgcatccagtttgcaaagtggggtcccatcaaggttcagcggcagtggatctgggacagaattcactctcacaatcagcagcctgcagcctgaagattttgcaatttattactgtctacagcatgatagttaccccctcactttcggcggagggaccaaggtggagatcaaac

SEQ ID NO: 7841 - DNA, 322 bp, Artificial Sequence
  Synthetic construct
gaaatagtggtgacgcagtctccagccaccctgtctctatctccaggggaaggaggcaccctctcctgcagggccagtcaaagtgttagcaccaacgtgaattggtatcaacagaaacctggccagcctcccaggctcctcatctatgctgcatccaccagggcccctggtgtcccagccaggttcagtggcggtgggtctgggacagacttcactctcaccatcagcagcctggagtctgaagattttgcagtttattactgtctgcagcatattacctggccttggacattcggccaagggaccaaggtggaaatcaaac

SEQ ID NO: 7842 - DNA, 340 bp, Artificial Sequence
  Synthetic construct
gatgttgtgatgactcagtctccactctccctgcccgtcacccttggacagccggcctccatctcctgcaggtccagtcaaagcctcgtacacagtgatggaaacatgtacttgaattggtttcagcagaggccaggccaatctccaaggcgcctaatttataaggtttctaaccgggactctggggtcccagacagattcagtggcagtgggtcaggcactgacttcacactgaaaatcagcagggtggaggctgaggatgttggagtttattactgcatgcaaggtacagactggcccccgtacacttttggccaggggaccaagctggagatcaaac

SEQ ID NO: 7843 - DNA, 340 bp, Artificial Sequence
  Synthetic construct
gatgttgtgatgactcagtctccactctccctgcccgtcacccttggacagccggcctccatctcctgcaggtctagtcaaagcctcgtacacagtgatggaaacacctacttgaattggtttcagcagaggccaggccaatctccaaggcgccttatttataaggtttctaaccgggactctggggtcccagacagattcagcggcagtgggtcaggcactgatttcacactgaaaatcagcagggtggaggctgaggatgttggggtttattactgcatgcaaggtacacactggcctccggtgacgttcggccaagggaccaaggtggaaatcaaac

SEQ ID NO: 7844 - DNA, 322 bp, Artificial Sequence
  Synthetic construct
gacatccagttgacccagtctccatcctccctgtctgcatctataggagacagagtcaccttcacttgcctggccagtcaggacatcactaactttttaaattggtatcagcacaaaccagggaaaccccctaccctcctgatctacgatgcatccagtttgaaagcaggggtcccatcaagattcagtggaagtggctctggaaaaaagtttactttcaccatcaataacctgcagcctgaagatattgcaacatattactgtcagcactatgatcatctcccgtggaccttcggcccagggacccaggtagaagtcagac

SEQ ID NO: 7845 - DNA, 322 bp, Artificial Sequence
  Synthetic construct
gacatccagatgacccagtctccatcctccctgtctacatctgtcggagacagagtgaccatcacgtgccaggcgagtcaggacataaccaaatatttaagttggtatcagcagagaccagggaaagcccctaagctcctgatctccgatgcttccaatttggaagcaggggtcccatctaggttcagtggcggtggatctgggacagattttactctcaccatcaacagcctacagcctgaagatattgcaacatattactgtcaacagtgtgatgatctcccgtacacttttggccaggggaccaagctggagatcaaac

SEQ ID NO: 7846 - DNA, 322 bp, Artificial Sequence
  Synthetic construct
gacatccagatgacccagtctccatcctccctgtctgcatctgtaggagacagagtcaccatcacttgccgggcgagtcaggacattagcacttctctagcctggtatcagcagagaccagggaaagcccctaaactcctgctctatgttacatccagattggaaagtggggtcccatttcggttcagtggcagtggatctgggacggctttcactctcagcatcagcagcctgcagcctgaagattttgcaacttattactgtcaacagttttatggtgccccattcactttcgggcctgggaccaaagtggatatgaaac

SEQ ID NO: 7847 - DNA, 322 bp, Artificial Sequence
  Synthetic construct
gaaattgtgttgacacagtctccagccaccctgtctttgtctccaggagaaagagccaccctctcctgcagggccagtcagagtattgacaccttcttaggctggtaccaacaaaaacctggccaggctcccagtctcctcatctatgatgcatccaacagggccagtggcatcccagccaggttcagtggcagtgggtctgggacagacttcattctcaccatcaccagcctagagcctgaagattttgctgtttattactgtcagcagcgcagcaactggcctctcactttcggcggagggaccagggtggagatcaaac

SEQ ID NO: 7848 - DNA, 322 bp, Artificial Sequence
  Synthetic construct
gacatccagatgacccagtctccatcctccctgtctgcatctgtaggagacagagttaccatcacttgccgggctagtcagagcattagcagttttttaaattggtatcagcagaaaccagggaaagcccctaaactcctgatctatgctgaatccagtttacaaagtggtgtcccctcaagattcactggcagtggatctgggacagatttcactctcaccatcaacagtctgcaacctgaagattttgcaacctacttctgtcaacagagttacgcctccccgactacgtttggccaagggaccagggtggaaatcaaac

SEQ ID NO: 7849 - DNA, 322 bp, Artificial Sequence
  Synthetic construct
gacatccagatgacccagtctccctcctccctgtctgcatctgtcggagacagagtcaccatcacttgccgggcaagtcagaccattatcacctatttaagttggtatcagaagaaaccagggacagcccctaagctcctgatctatgctgcgtcccatttacacagtggggtcccatcaagattcggtggcggtggatctgggacagagttcaccctcaccatcggcagtctacaacctgaagattttgcaacttactactgtcaacagagttacagaattcctcacacctttggccaggggaccaagctggagatcaacc

SEQ ID NO: 7850 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggagatcaaac

SEQ ID NO: 7851 - DNA, 319 bp, Artificial Sequence
  Synthetic construct
gacatccagatgacccagtctccatcctccctgtctgcatctgtgggagacagagtcaccatcacttgccgggcaagtcagagcattagtaattatttacattggtatcagcagaaaccagggagcgcccctaaactcctgatctatgctgcatacagattagaaaccggggtcccatcaaggttcagtggcagtgcatctggggcagacttcactctcaccatcagcagtctgcaacctgaagattttgcaacttacttctgtcaacagacttacaatacgatcactttcggcggcgggaccaaggtggagatcagac

SEQ ID NO: 7852 - DNA, 322 bp, Artificial Sequence
  Synthetic construct
gacatccacctgacccagtctccatcctccctgtctgcatctgcaggagacagggtcctcatcacttgccaggcgagtcaagacattaagaactacttaaattggtatcaacagaagccaggggaagcccctaacgtcctgatctacgatgcaaccaatttagagacaggggtctcatcaaggttcagtggaagtggatctgggacagatttcactctcaccatcaacagcctgcagcctgaagatattgcaacatatttctgtcaacaatatgatagtctcccggtcactttcggcggcgggaccaaggtgcagatcaaac

SEQ ID NO: 7853 - DNA, 325 bp, Artificial Sequence
  Synthetic construct
gaagttgtgttgacgcagtctccagacaccctctctttatatccaggggaaagagccaccctctcctgcagggccagtcagagtgtgagttccagttacttatcctggtaccaacaaaaacctggccaggctcccagactcctcatctatggtgcctccaccagggccactggcatcccagacaggttcattggcagtgggtctgggacagacttcactctcaccatcaacagactggagcctgaagattttgcagtgtattactgtcaacaatatggtagctccctgtacagttttggccaggggaccaagctggagatcaaac

SEQ ID NO: 7854 - DNA, 325 bp, Artificial Sequence
  Synthetic construct
gaaattgtgttgacgcagtctccagacaccctgtctttgtctccaggggaaagagccaccctctcctgtagggccagtcagagtgttaacagcaactacttagcctggtaccagcagaagcttggccaggctcccaggctcctcttctttggtgcatccagcagggccactggcatcccagacaggttcagtggcagtgggtctgggacagacttcactctgaccatcagcagactggagcctgaagattttgcaatatattactgtcagcagtatggtagctcaccgctcactttcggcggagggaccaaggtggagatcaaac

SEQ ID NO: 7855 - DNA, 331 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtatattactgtcagcagtatggtagctcacctccgcggttcactttcggccctgggaccaaagtggatatcaaac

SEQ ID NO: 7856 - DNA, 322 bp, Artificial Sequence
  Synthetic construct
gacattcagatgactcagtcccccagctccctgtcagcaagcgtgggggaccgggtctccatcacctgccaggcctcacaggatattagcagatacctgaactggtatcagcagaagcccggagaggcccctaaactgctgatctacgacgcttccaatctggaaacaggcgtgccttctaggttctccggctctgggagtggaactgacttcacctttacaatctctagtctgcagccagaggatattgctacatatttctgtcagcagtacggctatctgccactgacttttggccccgggaccaaggtcgatagcaaac

SEQ ID NO: 7857 - DNA, 322 bp, Artificial Sequence
  Synthetic construct
gacatccagatgacccagtctccttccaccctgtctgcatctgtaggagacagagtcaccatcacttgccgggccagtcagagtgttagtgattggttggcctggtatcagcagaaaccagggaaagcccctaaactcctgatttataaggcgtctaatttagaaagtggggtcccattaaggttcagcggcagtggatctgggacagaattcactctcaccatcagcagcctgcagcctgatgattttgcagtttattactgccaacagtataatgcttacccattcactttcggccctgggaccacagtggaaatcaaac

SEQ ID NO: 7858 - DNA, 325 bp, Artificial Sequence
  Synthetic construct
gaaatagtgatgaggcagtctccagccaccctgtctgtgtctccaggggaaagagccaccctctcctgcagggccagtcagagtgttagaaccaacatagcctggtaccaacaaaaacctggccaggctcccaggctcctcatctatgatgcgtccaccagggtcactggtatcccagccaggttcagtggcagtgggtctgggacagagttcactctcaccatcagcagcctgcagtttgaggattttgcagtttattactgtcagcagtataatcattggctccctctcactttcggcggagggaccaaggtggagatcaaac

SEQ ID NO: 7859 - DNA, 325 bp, Artificial Sequence
  Synthetic construct
gaaatagtgatgacgcagtctccagccaccctgtctgtgtctccaggggggcgagccaccctctcctgcagggccagtcagagtgttggcagcaacttagcctggtaccagcagaaacctggccaggctcccaagctcctcatctctgctgcatccaccagggccactggtatcccagccaggttcagtggcagtggatctgggacaaatttcactctcaccatcagcagcctgcagtctgaagattttgcagtttattactgtcagcaatataataagtggcctccgtggacgttcggccaagggaccaaggtggacatcaaac

SEQ ID NO: 7860 - DNA, 325 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcccccattcactttcggccctgggaccaaagtggatatcaaac

SEQ ID NO: 7861 - DNA, 322 bp, Artificial Sequence
  Synthetic construct
gaaatagtgatgacgcagtccccagccaccctgtctgtgtctccaggggacagagccaccctctcctgcagggccagtcagagtgttagcagcaacttagcctggtaccagcagaaacctggccaggctcccaggctcctcatctctggtgcatccaccagggccactgttatcccagccaggttcagtggcagtgggtctgggacagagttcactctcaccatcagcagcctgcaatctgaagattttgcagtttattactgtcagcagtataatagctggccatttactttcggccctgggaccaaactggatatcaaac

SEQ ID NO: 7862 - DNA, 319 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaac

SEQ ID NO: 7863 - DNA, 325 bp, Artificial Sequence
  Synthetic construct
gaaatagtgctgacgcagtctccagccaccctgtctctgtctccaggggaaagagccaccctctcctgcagggccagtcaaagtgttagcagcaacttagcctggtaccagcagaaacctggccaggctcccaggctcgtcatccatgatgtatcctccagggccaccggtatcccagccaggttcagtggcagtgggtctgggacagacttcactctcaccatcagcagcctgcagtctgaagattttgcagtttattactgtcagcaatataatgtctggcctacgatcaccttcggccaagggacacgactggagattaaac

SEQ ID NO: 7864 - DNA, 325 bp, Artificial Sequence
  Synthetic construct
gaaattgtgttgacgcagtctccaggcaccctgtctttgtctccaggggaaagagccaccctctcctgcaggcccagtcagagtgttagcagcaactacttagcctggtaccagcagaaacctggccaggctcccaggctcctcatctatggtgcatccagcagggccaccggcgtcccagacaggttcagtggcagtgggtctgggacagacttcactctcaccatcagcagactggagcctgaagattctgcagtgtattactgtcagcagtatcgtagctcaccattcactttcggccctgggaccaaagtggatatcaaac

SEQ ID NO: 7865 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatcgttactcaccgaggacgttcggccaagggaccaaggtggaaatcaaac

SEQ ID NO: 7866 - DNA, 337 bp, Artificial Sequence
  Synthetic construct
gacatcgtgatgacccagtctccagactccctggctgtgtctctgggcgagagggccaccatctactgcaggtccagccagagtgttttatccagaatcaacgataagaattacctagcttggtaccagcagaaatcaggacagcctcctaagctgctcctttactgggcatctacccgggaatccggggtccctgaccgattcagtggcagcgggtctgggacagatttcactctcaccatcagcagcctgcaggctgaagatgtggcagtttattactgtcagcaatattctagtttcgggactttcggccctgggaccaaagtggatatcaaac

SEQ ID NO: 7867 - DNA, 340 bp, Artificial Sequence
  Synthetic construct
gacatcgtgatgacccagtctccagactccctgggtgtgtctctgggcgagcgggccaccatcaactgcaagtccagccagagtcttttctacagctccaacaataagacctacctagcttggtaccagcagagaccacgacagtctcctagactgctcatttactgggcatctacccgggaatctggggtccctgaccgattcagtggcagcgggtctgcgacagatttcactctcaccatcagcagcctgcaggctgaagatgtggcaatttattactgtcagcaatattataatactccgtacacttttgcccaggggaccaaactggagatcaaac

SEQ ID NO: 7868 - DNA, 322 bp, Artificial Sequence
  Synthetic construct
gtcatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagttgcctgcagtctgaagattttgcaacttattactgtcaacagtattatagtttccctcgaacgttcggccaagggaccaaggtggaaatcaaac

SEQ ID NO: 7869 - DNA, 340 bp, Artificial Sequence
  Synthetic construct
gacatcgtgatgacccagtctccagactctctggctgtgtctctgggcgagagggccaccatcaactgcaagtccagccagagtgttttatacagctccaacaataagaactacttagcttggtaccagcacaaaccaggacagcctcctaagctgctcgtttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 7870 - DNA, 322 bp, Artificial Sequence
  Synthetic construct
gccatccggataacccagtctccatcctcactctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctctaacgttcggccaagggaccaaggtggaaatcaaac

SEQ ID NO: 7871 - DNA, 340 bp, Artificial Sequence
  Synthetic construct
gacatcgtgatgacccagtctccagactccctggctgtgtctctgggcgagagggccaccatcaactgcaagtccagtcagactgttttatacacctccactaataagaacttcttagcttggtttcagcagaaaccaggccagcctcctaagctgctcatttcctgggcatctagccgggaatccggggtccctgaccgattcagtggcagcgggtctgggacagatttcactctcaccatcagcagcctgcaggctgaagatgtggcagtttattactgtcaacagtattatactattccgcggacgttcggccaggggaccaaggtggaaatcaaac

SEQ ID NO: 7872 - DNA, 325 bp, Artificial Sequence
  Synthetic construct
tcctatgagctgacacagccaccctcggtgtcagtgtccccaggacagacggccaggatcacctgctctggagatgcattgccaaagcaatatacttattggtaccagcagaagccaggccaggcccctgtgctgatgatatataaagacactgagaggccctcagggatccctgagcgattctctggctccagctcagggacaacagtcacgttgaccatcagtggagtccgggcagaagacgaggctgactattattgtcaatcagcagacagcggtggtacttctgtgacattcggcggagggaccaagctgaccgtcctag

SEQ ID NO: 7873 - DNA, 325 bp, Artificial Sequence
  Synthetic construct
tcttctgagctgactcaggaccctggtgtgtctgtggccttgggacagacagtcaggatcacatgccaaggagacagcctcagaaggtattatgcaagttggtaccaacagaaaccaagacaggcccctctacttgtcatctatggtaacaataatcggccctcagggatcccagaccgattctctggctccaggtcaggaaacacagcttccttgaccatcactggggctcgggcggaagatgaggctgactattactgtcagtcccgggacagcagtggtaaccagctggtgttcggcagagggacgaagctgatcgtcctag

SEQ ID NO: 7874 - DNA, 322 bp, Artificial Sequence
  Synthetic construct
tcctatgagctgacacagccaccctcggtgtcagtgtccccaggacagacggccaggatcacctgctctggagatgcattgtcaaagcaatatgcttattggtaccagcagaagccaggccaggcccctgtgatgatgatatataaagacactgagaggccctcagggatccctgagcgattctctggctccagctcagggacaacagtcacgttgaccatcagtggagtccaggcagaagacgaggctgactattactgtcaatcagtagacagaagtggttctcatgtcttcggaagtgggaccaaggtcaccgtcctag

SEQ ID NO: 7875 - DNA, 325 bp, Artificial Sequence
  Synthetic construct
tcctatgtgctgactcagccaccctcggtgtcagtggccccaggacagacggcctacttttcctgtgggggaaccaacattggaagtaaaagtgtgcactggtaccagcagaagccaggccaggcccctctggtggtcgtctatgatgacagtgcccggccctcagggatccctgagcgattctctggatccaattctgggaacacggccaccctgaccatcagcagggtcgaaggcggggatgaggccgactattactgtcaggtgtgggatagtagtagtgatcattgggtgttcggcggagggacgaagctgaccgtcctag

SEQ ID NO: 7876 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcactaatcggccctcagggatttctaatcggttctctggctccaagtctggcaacacggcctccctgaccatctctgggctccaggctgacgacgaggctgattattactgcacctcatatacaaacgacagcaattctcaggcattcggcggagggaccaagctgaccgtcctag

SEQ ID NO: 7877 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacgacagcaattctcagctattcgtcggagggaccaagctgaccgtcctag

SEQ ID NO: 7878 - DNA, 334 bp, Artificial Sequence
  Synthetic construct
cagtctgccctgactcagcctgcctccgtgtctgggtctcctggacagtcgatcaccatctcctgcagtggaaccagcagtgacgttggtggttataagtatgtctcctggtaccaacaaaatccagacaaagcccccaaactcatgatttatgatgtcagtaatcggccctcagggatttctaatcgcttctctggctccaagtctggcaacacggcctccctgaccatctctgggctccaggctgacgacgagggtgattattactgcacctcatatacaaacgacagcaattctcaggtattcggcggagggaccaggctgaccgtcctag

SEQ ID NO: 7879 - DNA, 333 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccagccaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaaggtgaccgtcctag

SEQ ID NO: 7880 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataagtatgtctcctggtaccaacaaaacccaggcaaagcccccaaactcatgatttatgatgtcagtaatcggccctcagggatttctaatcgcttctctggctccaagtctgacaacacggcctccctgaccatctctgggctccaggctgacgacgaggctgattattactgcacctcatatacaaacgacagcaattctcaggtattcggcggagggaccaacctgaccgtcctaa

SEQ ID NO: 7881 - DNA, 334 bp, Artificial Sequence
  Synthetic construct
cagtctgccctgactcagcctgcctccgtgtctgggtctcctggacagtcgatcaccatctcctgcactggaaccagcagtgacgttggtagttataactatgtctcctggtaccaacaaaacccaggcaaagcccccaaactcatgatttctgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaacctgaccgtcctag

SEQ ID NO: 7882 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaagctgaccgtcctag

SEQ ID NO: 7883 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacgacaccaattctcaggtattcggcggagggaccaagctgaccgtcctag

SEQ ID NO: 7884 - DNA, 334 bp, Artificial Sequence
  Synthetic construct
cagtctgccctgactcagcctgcctccgtgtctgggtctcctggacagtcgatcaccatctcctgcactggaaccagcagtgacgttggtgtttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgacactgattattactgcacctcatatacaaacaacaacaattctcaggtattcggcggagggaccaacctgaccgtcctag

SEQ ID NO: 7885 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacaacaattctcaggtattcggcggagggaccaacctgaccgtcctag

SEQ ID NO: 7886 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataagtatgtctcctggtaccaacaaaacccaggcaaagcccccaaactcatgatttatgatgtcagtaatcggccctcagggatttctaatcgcttctctggctccaagtctgacaacacggcctccctgaccatctctgggctccaggctgacgacgaggctgattattactgcacctcatatacaaacaacagcaattctcatgtattcggcggagggaccaacctgaccgtcctaa

SEQ ID NO: 7887 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatggtttctgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 7888 - DNA, 334 bp, Artificial Sequence
  Synthetic construct
cagtctgccctgactcagcctgcctccgtgtctgggtctcctggacagtcgatcaccatctgctgcactggaaccagtagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaacctgaccgtcctag

SEQ ID NO: 7889 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 7890 - DNA, 334 bp, Artificial Sequence
  Synthetic construct
cagtctgccctgactcagtttgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcactaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccacgctgaccgtcctag

SEQ ID NO: 7891 - DNA, 334 bp, Artificial Sequence
  Synthetic construct
cagtctgccctgactcagcctgcctccgtgtctgggtctcctggacagtcgatcaccatttcctgcactggaaccagcagtgacgttggtgcttataagtatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 7892 - DNA, 333 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaattatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattcccaggtattcggcggagggaccaagctgaccgtcctag

SEQ ID NO: 7893 - DNA, 333 bp, Artificial Sequence
  Synthetic construct
cagtctgccctgactcagcctgcctccgtgtctgggtttcttggacagtcgatcaccatctcctgcactggaaccagcagtgacgttggtggttataactatgtctcctggtaccaacaaaacccagccaagcccccaaactcattatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 7894 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctgacaagacggcctccctgaccatctctgggctccaggctgacgacgaggctgattattactgcacctcatatacaaacaacagcaattctcaggtattcggcggagggaccacgctgaccgtcctag

SEQ ID NO: 7895 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaacctgaccgtcctag

SEQ ID NO: 7896 - DNA, 334 bp, Artificial Sequence
  Synthetic construct
cagtctgccctgactcaggctgcctccgtgtctgggtctcctggacagtcgatcaccatctcctacactggaaccagcagtgacgttggtgcttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggaggggccaagctgaccgtcctag

SEQ ID NO: 7897 - DNA, 334 bp, Artificial Sequence
  Synthetic construct
cagtctgccctgactcagcctgcctccgtgtctgggtctcctggacagtcgatcaccatctcctgcagtggaaccagcagtgacgttggtggttataagtatgtctcctggtaccaacaaaacccaggcaaagcccccaaactcatgatttatgatgtcagtaatcggccctcagggatttctaatcgcttctctggatccaagtctggcaacacggcctccctgaccatctctgggctccaggctgacgacgaggctgattattactgcacctcatatacaaacaacagcaattctcaggtattcggcggagggcccaagctgaccgtcctag

SEQ ID NO: 7898 - DNA, 334 bp, Artificial Sequence
  Synthetic construct
cagtctgccctgactcagcctgcctccgtgtctgggtctcctggacagtcgatcaccatctcctgcactggaaccagtagtgacgttggtgcttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgagggtgattattactgcacctcatatacaaacaacagcaattctcaggtattcggcggagggaccaagcggaccgtcctag

SEQ ID NO: 7899 - DNA, 322 bp, Artificial Sequence
  Synthetic construct
gacatccagatgacccagtctccatcctccctgtcttcatctgtcggagacagagtcaccatcacttgccaggcgagtcagggcattgccaactatttaaattggtttcagcaaaaaccagggcaagcccctaagctcctgatctacgatgcttccactttggcaacaggcgccccatcaaggttcagtggaagtggatctgggacacattttactctcaccatcagcagactgcagcctgatgatattgcaacatactactgtcaacactatgatcatctccctctcactttcggcggagggaccaaggtggagatcagac

SEQ ID NO: 7900 - DNA, 325 bp, Artificial Sequence
  Synthetic construct
gaagttgtgttgacgcagtctccaggcaccctgtctttgtctccaggggaaagagccaccctctcctgcagggccagtcagagtgttagcacctcctacttagcctggtaccagcagaaacccggccaggctcccaggctcctcatctatggtgcatacagcagggccgctggcatcccagagaggttccgtggcggcgggtctgggacagacttcactctcaccatcagcagactggagcctgaagattttgcagtctattactgtcagcagtatggtagctcaccgtggacgttcggccaagggaccaaggtggaagtcaaac

SEQ ID NO: 7901 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataggcattacttggcttggtaccagcagaaaccaggacagtctcctaaactgctcatttcctgggcatcttcccgggaatccggggtccctgaccgatttagtggcagcggatctgggacagatttcactctcaccatcagcagcctgcaggctgaagatgtggcactttattattgtcagcagtattatagtacttcgtggacgttcggccaagggaccaaggtggaaatcaaac

SEQ ID NO: 7902 - DNA, 322 bp, Artificial Sequence
  Synthetic construct
aaaattgtgttgacgcagtctccagccaccctgtctttgtctccaggggaaagagccaccctctcctgcagggccagtcagagtcttaccaccaactacttggcctggtaccagcagaaacctggccaggctcccaggctcctcatctacgatacatccaacagggccactggcatccccgacaggttcactggcagtgggtctgggacagacttcactctcaccatcagcagactggagcctgacgattttgcagtgtattactgtcagcaatatggtaattcagggacgttcggcctagggaccaaggtggaaatcaaac

SEQ ID NO: 7903 - DNA, 322 bp, Artificial Sequence
  Synthetic construct
gaaattgtgttgacgcagtctccaggcaccctgtctttgtctccaggggaaagagccaccctctcctgcagggccagtcaggctattagtagcagtaagttagcctggtatcaggaaaaacctggccaggttcccaggctcctcatctatgatgcatccagtagggccactggcatcccagacaggttcagtggcagtgggtctgggacagacttcactctcaccatcagcagactggagcctgacgattttgcagtgtattattgtcagcagtatggtggctcatccaccttcggccaagggacacgactggagattaaac

SEQ ID NO: 7904 - DNA, 325 bp, Artificial Sequence
  Synthetic construct
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccttcgctcactttcggcggagggaccaaggtggagatcaaac

SEQ ID NO: 7905 - DNA, 328 bp, Artificial Sequence
  Synthetic construct
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctgggggtcttcggaactgggaccaaggtcaccgtcctag

SEQ ID NO: 7906 - DNA, 325 bp, Artificial Sequence
  Synthetic construct
tcctatgtgctgactcagccaccctcggtgtcagtggccccaggacagacggccaggatgacgtgtgggggaaacaacattggaactaaaagtgtgcactggtaccagcagaagccaggccaggtccctgtgctggtcgtctatgatgatagcgaccggccctcagggatccctgagcgattctctggctccaactctgggaacacggccaccctgaccatcagcagggtcgaagccggggatgaggccgactattattgtcaggtgtgggatagtagtagtgatcatgtggtattcggcggagggaccaagctgaccgtcctag

SEQ ID NO: 7907 - DNA, 322 bp, Artificial Sequence
  Synthetic construct
gaaatagtgatgacgcagtctccagccaccctgtctgtgtctccaggggaaagagccaccctctcgtgcagggccagtcagagtgttagtagcaacttagcctggcaccagcagaaacctggccaggctcccaggctcctcatctatggtgcatccaccagggccactggtatcccagccaggttcagtggcagtgggtctgggacagagttcactctcaccatcagtagcctgcagtctgaagattttgcagtttattactgtcagcagtataagagctggcccctcgcgttcggcggagggaccaaggtggagatcaaac

SEQ ID NO: 7908 - DNA, 331 bp, Artificial Sequence
  Synthetic construct
cagtctgcgctgactcagtcaccctcagcgtctgagacccccgggcagagggtcaccatctcttgttctggaagcagctccaacatcggtactaaatatgtgtattggtatcagcagttcccaggaaaggccccccaactcctcatctttcggaataatcagcggccctcaggggtccctgaccgcttctctggctccaagtctggcacctcagcctccctggccatcagtgggctccggtccgaggatgaggctatttattactgtgcagcgtgggatgacaccctgagtgcttgggtgttcggcggagggaccaggctgaccgtcctag

SEQ ID NO: 7909 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcacctacttagcctggtatcaacagaaacgtggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcaaacgttcggccaagggaccaaggtggaaatcaaac

SEQ ID NO: 7910 - DNA, 325 bp, Artificial Sequence
  Synthetic construct
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaac

SEQ ID NO: 7911 - DNA, 340 bp, Artificial Sequence
  Synthetic construct
gatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccgtggacgttcggccaagggaccaaggtggaaatcaaac

SEQ ID NO: 7912 - DNA, 334 bp, Artificial Sequence
  Synthetic construct
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtcggggggtattcggcggagggaccaagctgaccgtcctag

SEQ ID NO: 7913 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaac

SEQ ID NO: 7914 - DNA, 331 bp, Artificial Sequence
  Synthetic construct
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctag

SEQ ID NO: 7915 - DNA, 322 bp, Artificial Sequence
  Synthetic construct
gccatccagatgacccagtctccatcctccctgtctgcatctgttggagacagagtcaccatcacttgccgggcaagtcaggacattagaaatgatttaggctggtatcagcagaaaccagggcaggcccctaagttcctgatctctggtgcctctcatttacaaagtggggtcccatcaaggtttagcggcagtggatctggcacagatttcactctcaccatcagcatcctgcggcctgaagattttgcaacgtattactgtgtacaggattacgattaccctcatacattcggccaagggaccaaggtggaaatcaaac

SEQ ID NO: 7916 - DNA, 93 bp, Artificial Sequence
  Synthetic construct
aggctgacgacgaggctgattttcagtgcacctcatatacaaacgacagcaattctcaggtcttcggcggagggaccaagctgaccgtcctag

SEQ ID NO: 7917 - DNA, 325 bp, Artificial Sequence
  Synthetic construct
tcctctgaactgacacagccaccctcggtgtcactgtccccaggacagacggccaggatcacctgctctggagatgaattgccagaccaatttgtctattggtaccagcagaagccgggccgggcccctatcttggtaatctataaggacactgcgaggccctcaggcatccctgcccgattctctggctccggctcagggacaacagctacattgaccatcagtggagtccaggcagaagacgaggctgattattactgtcaatcagtaggcactaatcatctttctgtggtcttcggcggcgggaccaggctgaccgtcctga

SEQ ID NO: 7918 - DNA, 334 bp, Artificial Sequence
  Synthetic construct
cagtctgccctgactcagcctccctccgcgtccgggtctcctggacagtcagtcaccatctcctgcactggaaccagcagtgacgttggtgggtataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcacctcatatgcaggcagcaacaatttcagggtcttcggaagtgggaccaaggtcaccgttgtag

SEQ ID NO: 7919 - DNA, 104 bp, Artificial Sequence
  Synthetic construct
caccgacctccaaactggggacgaggccgactattactgcgccgcttgggatgaccacctgcgaattgtgggtttcggcggggggaccaagctgaccgtcctag

SEQ ID NO: 7920 - DNA, 337 bp, Artificial Sequence
  Synthetic construct
agttttattctgactcagccgcactctgtgtcggagtctccggggaaggcggtgaccatctcctgttcccgcagcagcggcagcattaccagcagctttgtgcagtggtaccagcagcgcccgggcagtgcccccaccactgtgatctatgaggataaccaaaggccctctggggtccccgatcgcttctctgcctccgtcgacggctcctccaactctgcctccctcaccatctctggactgcagactgaggacgaggctgactactactgtcaatcttatgataccaccacggatcatgcagtcttcggaggaggcacccacctgaccgtcctcg

SEQ ID NO: 7921 - DNA, 322 bp, Artificial Sequence
  Synthetic construct
gacatccagatgacccagtctccatcctccctgtctgcatctgtgggagacagagtcaccatcacctgccgggcgagtcagggctttagtaattctttagcctggtatcagcagaaaccagggaaagcccctaaggtcctactctatactgcatccagattggaaagtggggtcccatccaggttcagtggcagtggatctgggacggattacactctcaccatcagcagcctgcagcctgaagattttgcaacttattactgtcaacagtatcatagtaccccgtggacgttcggccaagggaccaaggtggaaatcaaac

SEQ ID NO: 7922 - DNA, 322 bp, Artificial Sequence
  Synthetic construct
gacatccagatgacccagtctccatcctccctgtctgcatctgtaggagacagagtcaccatcacttgccgggcaagtcagggcattaacattgatttagcctggtatcagcagaaaccagggaatccccctaagcgcctgatctttgctgcatcctttttgaaaagtggagtcccatcaaggttcagcggcagtggatctgggacagaattcactctcacaatcaacagcctgcagcctgaagattttgcaacttatttctgtctacaacataatagttaccctcgaacgttcggccaagggaccaaggtggaaatcaaac

SEQ ID NO: 7923 - DNA, 322 bp, Artificial Sequence
  Synthetic construct
gacatccagatgacccagtctccttccaccctgtctgcatctgcaggagacagagtcaccatcacttgccgggccagtcagagtattagtagttggttggcctggtatcagcagaaaccagggaaagcccctaaactcctcatctataaggcgtctagtttagaaagtggggtcccatcaaggttcagcggcagtggatctgggacagaattcactctcaccatcagcagcctgcagcctgatgactttgcaacttattactgccaacagtatagtactgattcggcgacgttcggccaagggaccaaggtggaaatcaaac

SEQ ID NO: 7924 - DNA, 337 bp, Artificial Sequence
  Synthetic construct
cagtctgtactgacgcagccgccctcagtgtctggggccccagggcagagggtcaccatctcctgcactgggagcagctccaacatcggggcaggttatgatgtacactggtaccagcagcttccagggacagcccccaaactcctcatctttgggaacgacaatcggccctcaggggtccctgaccgattctctggctccaagtctggcacctcagcctccctggccatcactgggctccaggctgaggatgaggctgattattactgccagtcctatgacagtagcctgagtgattcgaaagtattcggcggggggaccaagctgaccgtcctgg

SEQ ID NO: 7925 - DNA, 340 bp, Artificial Sequence
  Synthetic construct
gacatcgtgatgacccagtctccagactccctggctgtgtctctgggcgagagggccaccctcaactgcacgtccagtcagagtgtcttatacagctccaacaataagaactacttagcttggtaccagcagaaaccaggacagcctcctaatttgctcatttactgggcatctacgcgggaagccggggtccctgaccgattcagtggcagcgggtctgggacagatttcactctcaccatcagcagcctgcaggctgaagatgtggcagtttattactgtcagcaatcttatactagtcctgtcactttcggcggagggaccaaggtggagatccaac

SEQ ID NO: 7926 - DNA, 325 bp, Artificial Sequence
  Synthetic construct
gaaattgtgttggcgcagtctccaggctccctgactttgtctccaggggaaagagccaccctctcctgcagggccagtcagagtgttaacagtaactatttagcctggtaccagcagaagtctggccaggctcccaggctcctcatctatggtgcgtccaacagggccactggcatcccagacaggttcagtggcagtgggtctgggacagacttcagtctcaccatcagccgactggagccggaagattttgcaatgtattactgtcagcagtatgcttcctcaccggtcactttcggcggagggaccaaggtggagatcaaac

SEQ ID NO: 7927 - DNA, 213 bp, Artificial Sequence
  Synthetic construct
acccaggcaaagcccccaaagtcttgatttatgagggcagtaagcggccctcaggggtttctaatcgcttctctggctccaagtctggcaacacggcctccctgaccatctctgggctccaggctgacgacgaggctgattattactgcacctcatatacaaacgacagcaattctcaggtattcggcggagggaccaagctgaccgtcctag

SEQ ID NO: 7928 - DNA, 322 bp, Artificial Sequence
  Synthetic construct
gacatccagatgacccagtctccttccaccctgtctgcttctgtgggagacagactcaccatcacttgccgggccagtcagagtattggtacttggttggcctggtatcagcaaaaaccagggaaagcccctaacctcctgatctataaggcgtctagtttgcaaaatggcgtcccatcgaggttcagaggcagtggatctgagacagagttcactctcaccatcagcaacctgcagcctgatgattctgcaacttattactgccaacactgtgatagttatccgtggacgttcggccaagggaccaaggtggaaatcaaac

SEQ ID NO: 7929 - DNA, 319 bp, Artificial Sequence
  Synthetic construct
tcctatgaactgacacagccatcctcagtgtcagtgtctccgggacagacagccaggatcacctgctcaggagatgtgttggcaaaaaaatattctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatcgagtcttcggaactgggaccaaggtcaccgtcctag

SEQ ID NO: 7930 - DNA, 325 bp, Artificial Sequence
  Synthetic construct
tccttagtgctgactcaacaacccacagtgtcagtggcccccggaaagacggccaccataacctgtggggggaccagaatggggactaggcttgtacactggtaccaacagaagccaggccaggcccctgtcgtgctcctctataatgacagcgaccggccctcagggatccctgaacgtttctccggctccaattctgagactatggccaccctgaccatcgactgggtcgaggccggggatgaggccgactatttctgtcaggcgtgggatgttgatagtgatcaaatggttttcggcggcgggaccaagttgaccgtcctag

SEQ ID NO: 7931 - DNA, 322 bp, Artificial Sequence
  Synthetic construct
gacattatgttgacgcagtctccaggcaccctgtctttgtctccaggggaaagagtcaccctctcctgcagggccagtcagagtgtgagcaacaactacttagcctggtacatcctgaaacctggccagactcccaggctcctcatctttggtgcatccagcagggccactggcatcccagacaggttcagtggcagtgggtctgggacagacttcacgctcaccatcagcagactggagcctgaggattttgcagtgtatttctgtcagcagtatgctacctcaccgacttttggccaggggaccaagctggagatcaaac

SEQ ID NO: 7932 - DNA, 325 bp, Artificial Sequence
  Synthetic construct
gaaatagtgatgacgcagtctccagccatcctgtctgtgtctccaggggacagagccaccctctcctgcagggccagtcagagtattaggagtgacttggcctggtaccagcagaaacttggccagcctcccaggctcctcatctttggtgcatccaccagggccactggtgtcccagacaggttcagtggcagtgggtctgggacagagttcactctcaccatcagcagcctgcagtctgaagattttgcagtttattactgtcagcagtattataactggcctccgcacacttttggccaggggaccaagctggacatcaaac

SEQ ID NO: 7933 - DNA, 322 bp, Artificial Sequence
  Synthetic construct
gacatccagatgacccagtctccatcctccgtgtctgcttctgtaggagacagagtcaccatcacttgccgggcgagtcaggccattagcaatgatttagcctggtatcagcagaaaccagggcagggtcctgaactcctcatctattctgcatccattctgcaggcaggggtctcatcgcgtttcagcggcagtggatctgggacaaatttcactctctccataagaaacctggagcctgaggatgttggcacttattactgtctgcggtgtaacggtttccctctcactttcggccctgggaccagagtggatatcaaac

SEQ ID NO: 7934 - DNA, 328 bp, Artificial Sequence
  Synthetic construct
gaaattgtgttgacgcagtctccaggcaccctgtctttgtctccaggggaaagagccaccctctcctgcagggccagtcagagtattagtggtacctacttagcctggtaccagcagaaacctggccaggctcccaggcttctcatttatggtgcatccagcagggccactggcatcccagacaggttcagtggcagtgggtctgggacagacttcactctcaccatcagcagactggagcctgaagattttgcagtgttttactgtcagcactatcctatgtcacctccgatcaccttcggccaagggacacgactggagattaaac

SEQ ID NO: 7935 - DNA, 319 bp, Artificial Sequence
  Synthetic construct
gacatccagatgacccagtctccttccaccctgtctgcatctgtaggagaaagagtcaccatcacttgccgggccagccagagtattagtacctggttggcctggtatcagcacaagccagggaaagcccctaggctcatgatctatagggcgtctagtttagaaagtggggtcccatcaaggttcagcggcagcggatctgggacagaattcactctcaccatcagcagcctgcagcctgatgattttgcaacttattactgccaacagtatcagagttattcgactttcggcggagggaccaaggtggagatcaaac

SEQ ID NO: 7936 - DNA, 331 bp, Artificial Sequence
  Synthetic construct
cagtctgtgctgactcagccaccctcagcatctgggacccccgggcagaggatcaccatctcttgttctggcagcagttccaacatcggaagtaacgctgtaaactggtaccagcagctcccaggaacgccccccaaactcctcatgttttctgataatcagcggccctcaggggtccctgaccgaatctctggctccaagtctggcacctcagcctccctggccatcagtggactccagtctgaggatgaggctgattattactgtgcagcatgggatgacaccctgcatggtgtggttttcggcggagggaccaagttgaccgtcctcg

SEQ ID NO: 7937 - DNA, 319 bp, Artificial Sequence
  Synthetic construct
tcctatgagctgacacagccatcctcagtgtccgtgtctccgggacagacagccaggatcacctgttcaggagatgtactggcaaaaaaacatgctcggtggttccagcaaaagccaggccaggcccctgtattggtgatttctaaagacagtgagcggccctcagggatccctgagcgattctccggctccagctcagggaccacagtcaccttgaccatcagccgggcccaggttgaggatgaggctgactattactgttactctgcggctgacaagagtctggtattcggcggagggaccaagctgaccgtcctac

SEQ ID NO: 7938 - DNA, 328 bp, Artificial Sequence
  Synthetic construct
tcctatgagctgacacagccaccctcggtgtcagtgtccccaggacagacggccaggatcccctgctctggaggtgctttgccaaagcaatatgcttattggtaccagcggaagccaggccaggcccctcgactggtgatctatcaagacagtgagaggccctcagggatccctgagcgattctctggctccaattcagggacaacagtgacgttgaccatcactggagtccaggcagaagacgaggctgactattactgtcaatccgcagacagtagtggttcttatcctgtggttttcggcggagggaccaaactgaccgtcctag

SEQ ID NO: 7939 - DNA, 331 bp, Artificial Sequence
  Synthetic construct
cagtctgccctgactcagcctccctccgcgtccgggtctcctggacagtcagtcaccatctcctgcactggaaccagcagtgacgttggtgactataagtatgtctcctggtaccaacaacacccaggcaaagcccccaaactcatgatttatgaggtcaataagcggccctcaggggtccctgatcgcttctctggctccaagtctggcaacacggcctccctgaccgtctctggcctccaggctgaagatgagggtgattattactgcagctcattggaaggcaggaacaattgggtgttcggcggagggaccaaactgaccgtcctag

SEQ ID NO: 7940 - DNA, 322 bp, Artificial Sequence
  Synthetic construct
gacatccagatgacccagtctccttccaccctgtctgcatctgtcggagacagagtcaccatcacttgccgggccagtcagagtattaatagttggttggcctggtatcagcagaaagcagggcaagcccctaagctcctgatctatcaggcgtctactttagaaaaaggggtcccatcacggttcagcggcagtggatctgggacagaattcactctcaccattagcagtctgcagcctgatgattttgcaacttacttctgtcaacagtataagagttacaagtggacgttcggccaggggaccagggtggatatcaagc

SEQ ID NO: 7941 - DNA, 337 bp, Artificial Sequence
  Synthetic construct
cagtctgtgctgacgcagccgccctcagtgtctggggccccagggcacaaggtcaccatctcctgcactgggagcggctccaacatcggggctcctcatgatgtaaactggtaccaacaacttccaggagaagtccccaaactcctcatttatggcaacaacaatcggccctcaggggtccctgaccgattctctggctccaagtctggcacctcagcctccctgataatcactgggctccagactgaggatgaggctgtttattattgccagtcctttgacaacagtgtgggtgtccaagtgattttcggcggagggaccacgctgaccgtcctag

SEQ ID NO: 7942 - DNA, 337 bp, Artificial Sequence
  Synthetic construct
gaaattgtgatgactcagtctccactctccctgcccgtcgcccctggagagccggcctccatctcctgcacgtctagtcagagcctcctggaagtaaatggaaacacctatttagattggtacctggtgaagcctggacagcctccacaactcctcatttacttaacttctactcgggcctccggggtccctgacaggttcattggcactggatcaggcattgattttacactgaaaatcaccagggtgcaacctgaagatgttggggtgtattactgcatgcagcatctaaaaattcctcggacttttggccaggggaccaagctggagatcagac

SEQ ID NO: 7943 - DNA, 331 bp, Artificial Sequence
  Synthetic construct
gaaattgtgttgacgcagtctccaggcaccctgtctttgtctccaggggaaactgccaccctctcctgcagggccagtcggagtgtttacagcaactacttggcctggtaccaacagaaacctggccagcctcccaggctcctcatctatggtatttccaacagggccactggcatcccagacaggttcagaggcagtgggtctgggacagacttcactctcaccatcagcagactggagcctgaagattttgcagtgtattactgtcagcagtatagtggctcacttcccccatacacttttggccaggggaccaaggtggagatcagcc

SEQ ID NO: 7944 - DNA, 331 bp, Artificial Sequence
  Synthetic construct
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatggcagcaatcagttattcggcggagggaccaagctgaccgtcctac

SEQ ID NO: 7945 - DNA, 328 bp, Artificial Sequence
  Synthetic construct
gacatccagatgacccagtctccttccaccctgtctgcatctgtgggagacagagtcaccatcacttgccgggccagtcagagtcttagtgactggttggcctggtatcagcagaaaccagggaaagcccctaaactcctgatctataaggcatctactttagaaagtggggtcccatcaaggttcagcggcagtggatctgggacagaattcactctcacgatcagcagcctgcagcctgatgattttgcatcttattactgccaacagtataatacttactctcccacgtgggcattcggccaagggaccaaggtggaaatcaaac

SEQ ID NO: 7946 - DNA, 322 bp, Artificial Sequence
  Synthetic construct
gacatccagatgacccagtctccttccaccctgtctgcatctgtaggagacagagtcaccatcacttgccgggccagtcagagtattagtgtctggttggcctggtatcagcagagaccagggaaagcccctaagctcctgatctataaggcgtctaatttagaaagtggggtcccatcaagattcagcggcagtggatctgggacagaattcactctcaccatcagcagcctgcagcctgatgattttgcaacttattactgccaacactataatagttacccgtacacttttggccaggggaccaagttggagatcaaac

SEQ ID NO: 7947 - DNA, 322 bp, Artificial Sequence
  Synthetic construct
tcctatgacctgagtcagccaccctcagtgtccgtgtccccacgacagacagccaacatcacctgctctggacatgaattgggggataaatttgcttcctggtatcaacagaagccaggccagtcccctgttctggtcatctatcaagataccaagcggccctcagggatccctgaccgattctctggctccaactctggaaacacagccactctgaccatcagcgggacccaggctatggatgaggctgactattactgtcaggcgtgggacagcaacacttttgtgatgttcggcggagggaccaagctgaccgtcctag

SEQ ID NO: 7948 - DNA, 325 bp, Artificial Sequence
  Synthetic construct
gaaatagtgatgacgcagtctccagccaccctgtctgtgtctccagggggaagagccaccctcacctgcacggccactgtgagtgttaacagcaacttagcctggtaccagcagaaacctggccaggctcccaggctcctcatttatggtgcatccaccagggccactggtgtcccagcccggttcagtggcactgggtctgggacagagttcttgctcaccatcaccagcctgcagtctgaagatttcgcagtttattattgtcaacaatataatgactggcctccggtcactttcggcggagggaccaaggtggagatcaaac

SEQ ID NO: 7949 - DNA, 322 bp, Artificial Sequence
  Synthetic construct
caaattgtgttgacgcagtctccaggcaccctgtctttgtctccaggggaaagagccaccctctcctgcagggccagtcacactgttaccgccgactacttagcctggtaccaccacaaacctggccaggctcccaggctcctcatctatggtacatccagcagggccgctggcatcccagacaggttcagtggcagtgggtctggggcagacttcgctctcaccatcaccagactggagcctgaagattttggggtgtattactgtcagcaatatggtagctcacccactttcggcggagggaccaaggtcgagatcaaac

SEQ ID NO: 7950 - DNA, 340 bp, Artificial Sequence
  Synthetic construct
gacatcgtgatgacccagtccccagactccctggctgtgtctctgggcgcgagggccaccatcaactgcaagtctagtcagagagtctccgagggcgccaacaattacaaatacgtcgcttggtaccagcacaaaacagggcagcctcctaagttgctcatttactgggcgtctgcccgggagtccggggtccctgcccgatttagtgccagcgcctctgggacagatttcactctcaccatcgacagcctgcaggctgaggatgtggccgtttattactgtcagcagtattttcgtagtcctcacacgttcggccaagggaccaaggtggaaatcaacc

SEQ ID NO: 7951 - DNA, 337 bp, Artificial Sequence
  Synthetic construct
gatgttgtggtcactcagtctccactttccctgcccgtcatccttggacagccggcctccatctcctgcaggtccagtcacagcctcctccaccatgataggaaaaccttcttgagttggtttcaccagaggccaggccagtctccacggcgcctcatttatgaggtttttaaccgggactctggggtcccagacagattcagcggcagtggggcaggctctgagttcacgctgacaatcagtagcgtggaggtcgaggatgttggcatttattactgcatgcaagggacacactggcctctgacttttggccaggggacgaaactggagatcaagc

SEQ ID NO: 7952 - DNA, 322 bp, Artificial Sequence
  Synthetic construct
gacatccagatgacccagtctccatcctccctgtctgcatctgtaggagacagagtcaccatcacttgccaggcgagccagggcattagcacctatttaaattggtatcagcagaaaccagggaaagcccctaagctcctgatctatgatgcatccactttggagacaggggtcccatcaaggatcagtggaactggatctgggacaacttttactttcaccatcaccagcctgcagcctgaagatattgcaacatattactgtcaacagtataatagtctcccgtggacgttcggccaggggaccaaggtggaaatcaaac

SEQ ID NO: 7953 - DNA, 328 bp, Artificial Sequence
  Synthetic construct
gaaattgtgttgacgcagtctccaggcaccctgtctttgtctccaggggaaagagccaccctctcctgcagggccagtcagagtattaacagcaactacttagcctggtaccagcagaaacctggccaggctcccaggctcctcatctatggtgcatccagcagggcccctggcatcccagagaggttcagtgtcagtgggtctgggacagatttcactctcaccatcagcagtctggagcctgaagattttgcagtgtattactgtcagcaatttggtggctcccctctgtacacttttggccaggggaccatactggagatcaaac

SEQ ID NO: 7954 - DNA, 325 bp, Artificial Sequence
  Synthetic construct
gaaatagtcatgacgcagtctccagccaccctgtctgtgtctccaggggaaagagccaccctctcctgcagggccagtcagagtgttggcggcaacttagcctggtaccagcaaaaacctggccaggctcccaggctcctcatccacgatgcatccaccagggccactggtatcccagccaggttcagtggcagtgggtctgggacagagttcactctcaccatcagcagcctgcagtctgaagattttgcagtttattactgtcagcagtattatgactggcctccgtggacgttcggccaagggaccaaggtggaaatcaaac

SEQ ID NO: 7955 - DNA, 334 bp, Artificial Sequence
  Synthetic construct
cagtctgtgcttattcagccaccctcagcgtctgggacccccgggcagagggtctccatcccttgctctgggagcaggtcccacttcgccataaattttgttctgtggtatcaacaattcccaggagtggcccccaaactcctcatctacagcaatgatcagcggccctcagatgtctctgaccgattctctggctctaagtctggcaactcagcctccctgaccatcagtggactccggtccgaggatgaggcagactattattgtgttgcatgggatgtcaatctgagtggtcctgtgctcatcggcggcgggaccaagctgaccgtcctag

SEQ ID NO: 7956 - DNA, 325 bp, Artificial Sequence
  Synthetic construct
ggcatcctgttgacccagtctccaccgtccctgtctgcatccgagggagacagagtcaccatcacttgccgggcaaatcagaccatcgctacttctttaaattggtatcaacaaaaagcagggaaagcccctaagctcctgatctctgccgcctccactttgcaaagtcatgtcccatctagattcagtggcagtggatccgggacagatttcactttcaccatcagcagtctgcaacctgaagattttgcgacatattactgtcaacagagttacagtaccctcgcggtcactttcggcggggggaccaaggtggacgtcaagc

SEQ ID NO: 7957 - DNA, 331 bp, Artificial Sequence
  Synthetic construct
cagactgtggtgacccaggagccatcgttctcagtgtcccctggagggacagtcacactcacttgtggcttgacctctgactcagtctctacttcttactaccccagctggtaccagcagaccccaggccaggctccacgcacgctcatctacagcacaaacactcgctcttctggggtccctgatcgcttctctggctccatccttggaaacaaagctgccctcaccatcacgggggcccaggcagatgatgaatctgattattactgtcttctctatatgggtactggctcttgggtgttcggcggagggaccaaggtgaccgtcctag

SEQ ID NO: 7958 - DNA, 325 bp, Artificial Sequence
  Synthetic construct
gaaattgtgttgacgcagtctccaggcaccctgtctttgtctccaggggaaagagccaccctctcctgcagggccagtcagagtgttcgcagcacctacttagcctggtaccagcagaaacctggccaggctcccaggctcctcatctatggtgcatccagcagggccactggcatcccagacaggttcagtggcagtgggtctgggacagacttcgctctcaccatcaacagactggagcctgaggattttgcagtgtattactgtcagcagtatgttagttcacccctgacgttcggccaagggaccaaggtggaaatcaaac

SEQ ID NO: 7959 - DNA, 325 bp, Artificial Sequence
  Synthetic construct
gaaattgtgttgacgcagtctccaggcaccctgtctttgtctccaggggaaagcgccaccctctcctgcagggccagtcagagtattagcagcagttatttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtatttctgtcaccagtatggtagttcagcgaggacttttggccaggggaccaacctggagatcaaac

SEQ ID NO: 7960 - DNA, 322 bp, Artificial Sequence
  Synthetic construct
gacatccagatgacccagtctccttccaccctgtctgcatctgtcggagacagagtcaccatcacttgccgggccagtcagagtattagtgactggttggcctggtatcagcagaaaccagggaaagcccctaacctcctaatttatagggcatctactttaaaaagtggggtcccgtcaaggttcagcggcagtggatctgggacagacttcactctcaccatcagcagcctgcagcctgatgattttgcaacttattactgccaacactatgatagatattcagcgacgttcggccaagggaccaaggtggaaatcaaac

SEQ ID NO: 7961 - DNA, 308 bp, Artificial Sequence
  Synthetic construct
gaaattgtgttgacgcagtctccaggcaccctgtctttgtctccagggggaagagccggtctctcctgtagggccagtcagagtgtttctaacgactacttagcctggtaccagcagagacctggccaggctcccaggctcctcatctatggtgcttccaccagggccactggcatcccagacaggttcggtggcagcgggtctgggacagacttcacgctcaccatcagcagactggagcctgaagattttgcagtctatttctgtcaacagtatggcagttcgcctcagacgttcggccaagggac

SEQ ID NO: 7962 - DNA, 319 bp, Artificial Sequence
  Synthetic construct
gaaattgtgctgactcagtctccagactttcaggctgtgactccaaaggagaaagtcaccatcacctgccgggccagtcagagcattggtagtaacttacactggtaccagcagaaaccagatcagtctccaaagctcctcatcaagcatgcttcccagtccttctcaggggtcccctcgaggttcagtggcagtggatctgggacagatttcaccctcaccatcaatagcttggaagctgaagatgctgcaacgtattactgtcatcagagtagtagttggtacacttttggccaggggaccaagctggagatcaaac

SEQ ID NO: 7963 - DNA, 328 bp, Artificial Sequence
  Synthetic construct
gaaattgtgttgacacagtctccaggcaccctgtctttgtctccaggggaaagagccaccctctcctgcagggccagtcagagtgttggcatctacttagcctggtatcaacaaaaacctggccaggctcccaggctcctcatctctgatgcattcaccagggccgctggcatcccagccaggtttagtggcagtgggtctgggacacacttcactctcaccatcagcagcctagagcctgaagattttggagtttattactgtcagcagcggagcaatgggcgtccgagggtcactttcggcggagggaccaaggtggagatcaaac

SEQ ID NO: 7964 - DNA, 322 bp, Artificial Sequence
  Synthetic construct
gccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattacccctggaagttcggccaagggaccaaggtggaaatcaaac

SEQ ID NO: 7965 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtggacgttcggccaagggaccaaggtggaaatcaaac

SEQ ID NO: 7966 - DNA, 322 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccaacgttcggccaagggaccaaggtggaaatcaaac

SEQ ID NO: 7967 - DNA, 337 bp, Artificial Sequence
  Synthetic construct
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctcagacgttcggccaagggaccaaggtggaaatcaaac

SEQ ID NO: 7968 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 7969 - DNA, 325 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctacgtacacttttggccaggggaccaagctggagatcaaac

SEQ ID NO: 7970 - DNA, 325 bp, Artificial Sequence
  Synthetic construct
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtggtattcggcggagggaccaagctgaccgtcctag

SEQ ID NO: 7971 - DNA, 331 bp, Artificial Sequence
  Synthetic construct
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttatgtcttcggaactgggaccaaggtcaccgtcctag

SEQ ID NO: 7972 - DNA, 322 bp, Artificial Sequence
  Synthetic construct
gccatccagatgacccagtctccatcctccctgtctgcatctgtaggagacagagtcaccatcacttgccgggcaagtcaggacattagaaatgatttaggctggtatcagcagaaaccagggaaagcccctaggctcctgatctatcgtgcatccactttacaaagtggggtcccgtcaaggttcagcggcagtgtgtctggcacagatttcactctcaccatcagcagccttcagcctgaagattttgccacttattactgtctacaggattacaattacccgtgggcgttcggccaagggacccaggtggaaatcaaac

SEQ ID NO: 7973 - DNA, 331 bp, Artificial Sequence
  Synthetic construct
aactttatgttgactcagccccactctgtgtcggagtcaccggggaagacggtaaccatctcttgtattcgcggcagtggcagcataaccagcgcctatgtgcagtggttccaactgcgcccgggcagtgtccccaccactgtgatctatgaggataaccaaagaccctctggggtccctgatcggttctctggctccatcgacagctcctccaactctgcctccctcaccatctctggactgaagactgaggacgcggctgactactactgtcagtcttatgaaaacagttattgggtgttcggcggagggaccaggctgaccgtcctag

SEQ ID NO: 7974 - DNA, 322 bp, Artificial Sequence
  Synthetic construct
gaaatagtgatgacgcagtctccagccaccctgtctgtgtctccaggggatagagccaccctctcctgcagggccagtcagagtgtgagcagcagcttagcctggtaccagcacaaacctggccaggctcccaggctcctcatctatggtgcatcctccagggccactgatatcccagtcaggttccgtggcagtgggtctgggacagagttcactctcaccatcagcagcctgcagtctgaagattttgcagtttattactgtcagcaatattataactggcctcggacgttcggccaagggaccaaggtggaaatcaaac

SEQ ID NO: 7975 - DNA, 325 bp, Artificial Sequence
  Synthetic construct
tcttatgtgctgactcagccaccctcggtgtcagtggccccaggacagacggccaggattacctgtgggggagacaacattagaagtaagagtttgcactggtaccagcagaagccaggccaggcccctgttttggtcgtctatgatgatagcgaccggccctcagggatccctgagcgattctctggctccaactctgggaacacggccaccctgaccatcaccagagtcgaagccggggatgaggccgactattcctgtcaggtgtgggatagtagtggtgatcatccggtgttcggcggagggaccaagctgaccgtcctag

SEQ ID NO: 7976 - DNA, 331 bp, Artificial Sequence
  Synthetic construct
cagtctgccctgactcagcctcgctcagtgtccggatctcctggacagtcagtcaccatctcctgcactggaaccagcagtgatgttggtggttataattctgtctcctggtaccaacaccacccaggcaaagcccccaaactcatgatttatgatgtcactaagcggccctcaggggtccctgatcgcttctctggctccaagtctggcaacacggcctccctgaccatctctgggctccaggctgaagatgaggctgattattactgctgctcatatgcaggcagctacactcatgtcttcggaactgggaccaaggtcaccgtcctag

SEQ ID NO: 7977 - DNA, 343 bp, Artificial Sequence
  Synthetic construct
gacatcgtggtgacccagtctccagactccctggctgtgtctctgggcgagagggccaccatcaactgcaagtccagccagagtgttttatccagctccaacaataaggactacttagcttggtaccagcagaaaccaggacagcctcctaagctgctcatttactgggcatctacccgagaatccggggtccctgaccgattcagtggcagcgggtctgggacagatttcactctcaccatcaacagcctgcaggctgaagatgtggcagtttattactgtcaggaatttcatgatactctcgggctcactttcggcggagggaccagggtggagatcaaac

SEQ ID NO: 7978 - DNA, 322 bp, Artificial Sequence
  Synthetic construct
gacatccagatgacccagtctccatcctccctgtctgcatctgtgggagacagagtcaccatcacttgccgggcgagtcagaccgtaaccaggtttttaaattggtatcagctcagaccgggggaagcccctaacctcctgatccattctacttccactttgcaaagtggagtcccgtcaaggttcagtggcagtggttctgggacagatttcactctcaccatcagcagtctgcaacctgaagattttgcgatttacttctgtcagcagacttacagtgccccatggacgttcggccaggggaccaaggtggaggtcaaac

SEQ ID NO: 7979 - DNA, 325 bp, Artificial Sequence
  Synthetic construct
gaaatagtgctgacgcagtctccagccaccctgtctgtgtctccaggggaaagagccaccctctcctgcagggccagtcggcctgttagcagcaacttagcctggtaccagcagagacatggccaggctcccaggctcctcatctatgccgcatccaccagggccactggtatcccagccaggttcagtggcagtgggtctgggacagagttcactctcaccatcagcagcctgcagtctgaagatttggcggtttattactgtcaacattatgttaactggcctccgtggacgttcggccaggggaccaaggtggaaatcaaac

SEQ ID NO: 7980 - DNA, 322 bp, Artificial Sequence
  Synthetic construct
gacatccagatgacccagtctccgtcctccctgtctgcatctgtaggagacagagtcaccatcacttgccgggcaagtcagggcattggaaatgatttaggctggtatcagcaaaaaccagggaatgcccctaagcgcctgatctacgatgcatccagtttgcaaagtggggtcccatcgaggttcagcggcagtggatctgggacagaattcactctcacaatcagcagcctgcagcctgaagattttgcaacctattactgtctacaacataatagttaccctctcactttcggcggagggaccaaggtggaggtcaaac

SEQ ID NO: 7981 - DNA, 337 bp, Artificial Sequence
  Synthetic construct
gatattgtgatgactcagtctccactctccctgcccgtcacccctggagagccggcctccatctcctgcaagtctagtcagagcctcctgcatagtcatggatacaactatttggcttggtacctgcagaggccagggcagtctccacagctcctaatctacttgggatctactcgggcctccggagtccctgccaggttccgtggcactggatcaggcacagattttacactgagaatcagcagagtggaggctgaggatgttggggtttattactgcatgcaggctctacagactcctcccaccttcggccaagggaccaaggtggaaatcaaac

SEQ ID NO: 7982 - DNA, 106 bp, Artificial Sequence
  Synthetic construct
atctctgggctccaggctgacgacgaggctgattattactgcacctcatatacaaacgacagcaattctcaggtattcggcggagggaccaagctgaccgtcctag

SEQ ID NO: 7983 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagttcctgatctatgctgcattcaatttgcaagatggagtcccatcaaggttcagtggcagtggatctgggacagatttcactctcaccatcagtagtctccaacctgaagattttgcaacttactactgtcaacagagttacagcacccccttcactttcggccctgggaccagagtggatatcaaac

SEQ ID NO: 7984 - DNA, 313 bp, Artificial Sequence
  Synthetic construct
tcttctgggctgactcaggaccctgttgtgtctgtggccttggggcagacagtcaagatcaaatgccagggtgacagactcaaaacctggctccaacagaggcctggacaggcccctcgacttgtcctctacgataaagacaaacggccctcagggatcccagaccgattctctggctccagctcaggaaacacagataccttgaccatcactggggttcaggcggaagatgagggtgactattattgttattcccgtgccggtactggtgaccatgtggtgttcggcggagggaccaagctgaccgtcctag

SEQ ID NO: 7985 - DNA, 325 bp, Artificial Sequence
  Synthetic construct
gaaattgtgttgacacagtctccagccaccctgtccttgtctccaggggaaagagccaccctctcctgcagggccagtcagagtgttagcagttccttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcactttattactgtcagcagcgtagcgactggccgcctctcactttcggcggagggaccaaggtggagatcaacc

SEQ ID NO: 7986 - DNA, 334 bp, Artificial Sequence
  Synthetic construct
cagttaatgctgactcaagcgccctctgcctctgcctcactgggagcctcacttaacctcaaatgcactctggacagtggacacgacacctacgccgtcgcttggcttcagcagcggccagggaagggccctcgattcttgatgacggttgatcctgacggcaattatcatcaggatgacgagttgtctgatcgcttctcaggctccttctctggggctgaccgctacctcaccatctccagcctccagcctgaggatgaggctgactattactgtcagacctgggacactggcgttcgcctgttcggcggagggaccaagctgaccgtcctag

SEQ ID NO: 7987 - DNA, 322 bp, Artificial Sequence
  Synthetic construct
gaaagagtgatgacgcagtctccagccaccctgtctgtgtctccaggggaaagagccaccctctcctgcagggccagtcagagtgttagcagcaacttagcctggtaccagcagaaacctggccagggtcccaggctcctcatctatggtgcatccaccagggccactggtatcccagccacgttcagtggcagtgggtctgggacagagttcactctcaccatcagcagcctgcagtctgaagattttgcagtttattactgtcagcagtataatgactggccgtggacgttcggccaagggaccaaggtggaaatcaaac

SEQ ID NO: 7988 - DNA, 322 bp, Artificial Sequence
  Synthetic construct
gacatccagatgacccagtctccatcctccctgtctgcatctgtaggagacagagtcaccatcacttgccgggcgagtcagggcattagcaattatttagcctggtatcagcagaaaccaggcaaagttcctaagctcctgatctatgctgcatccactttgcaatcaggggtcccatctcggttcagtggcactggatctgggacagatttcactctcaccatcagcagcctgcagcctgaagatgttgcaacttattactgtcaaaagtataacagtgccccgctcactttcggcggagggaccaaggtggagatcaaac

SEQ ID NO: 7989 - DNA, 322 bp, Artificial Sequence
  Synthetic construct
gacatccagatgacccagtctccatcctccctgtctgcatctgtaggagacagagtcaccatcacttgccgggcgagtcagaacatttacaattatttagtctggtatcaacagaaacctgggaaagttcctaagctcctgatttatgctgcatccactttgcattcaggggtcccatctcggttcagtggcagtggttctgggacagatttcactctcaccatcagcagcctgcagcctgaagatgttgcaacttattactgtcaaaactataacagtgccccattcactttcggccctgggaccaaagtggatatcaaac

SEQ ID NO: 7990 - DNA, 325 bp, Artificial Sequence
  Synthetic construct
tcttctgagctgactcaggaccctgctgtgtctgtggccttgggacagacagtcaggatcacatgccaaggagacagcctcagaaattattatgcaagttggtaccagcagaagccaggacaggcccctgtgtttgtcatctatggtaaaaacaaccggccctcagggatcgcagaccgattctctggctccatctcaggaaacacagcttccttgaccatcactggggctcaggcggaagatgaggctgactattactgtaactcccgggacaccagtggtaaccgttgggtgttcggcggagggaccaaactgaccgtcctag

SEQ ID NO: 7991 - DNA, 319 bp, Artificial Sequence
  Synthetic construct
gaaatagtgatgacgcagtctccagccaccctgtctgtgtctccaggggaaagagccaccctctcctgcagggccagtcagagtgttaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgactggctgatcacgttcggccaagggacacgactggagattaaac

SEQ ID NO: 7992 - DNA, 331 bp, Artificial Sequence
  Synthetic construct
cagtctgtgctgactcagcccccctcaacgtctgggacccccgggcagagggtcaccatctcttgttctgggaccagctccaacatcggatttaattctgtgaactggtaccagcacctcccaggaacggcccccaaactcctcatctttaggactaatgagcggccctcaggggtccctgaccgtttctctggctccaagtctggcacctcagcctccctggccatcagtgggctccaggctgaggatgaggctgattattactgtgcatcatgggatgacagcctgaatggttgggggttcggcggagggaccaaactgaccgtcctag

SEQ ID NO: 7993 - DNA, 322 bp, Artificial Sequence
  Synthetic construct
tcctatgtactgactcagccaccctcggtgtcagtggccccaggacagacggccaagattacctgtgggggaaacaacattggaagtaaaactgtccactggtaccagcagaagccaggccaggcccctgtgctcgtcgtctttgatgatagcgaccggccctcagggatccctgagcgattctctggctccaaatctgggaacacggccaccctgaccatcggcagggtcgaagccggggatgaggccgacttttactgtcaggtgtgggatagtagtactgatcatctattcggcggcgggaccaagctgaccgtcctag

SEQ ID NO: 7994 - DNA, 331 bp, Artificial Sequence
  Synthetic construct
cagtctgtcttgactcagccaccctcagtgtctgggacccccgggcagagggtcaccatgtcttgttctggaagcagctcaaacatcggaagaaaccctgtaaactggtatcagcaagtcccaggatcggcccccaaagtcctcatgtatagggattctcaacggcccacaggggtccccgaccgattcctcggctccaactctggcacctcagcctccctggccatcagtgacctccagactgacgatgaggctgattattactgtgcagtttgggatgacaacctgagggcttgggtgttcggcggagggaccaagttgaccgtcctag

SEQ ID NO: 7995 - DNA, 322 bp, Artificial Sequence
  Synthetic construct
gacatccagatgacccagtctccatcctccctgtctgcgtctgtaggagacagagtcaccatcacttgccgggcgagtcagggcattagcaattatttagcctggtatcagcagacaccagggaaagttccaaagctcctgatctacgctgcatccactttgcagtcaggggtcccatctcggttcagtggcagtggatctgggacagaattcactctcaccatcagcagcctgcagcctgaggatgttgcaacttattactgtcaaaagtataacagtgccccattcactttcggccctgggaccaaagtggaaatcaaac

SEQ ID NO: 7996 - DNA, 217 bp, Artificial Sequence
  Synthetic construct
tcttctgagctgactcaggaccctggtgtgtctgtggccttgggacagacagtcaggatcacatgccaaggagacagcctcagaaggtcaggaaacacagcttccttgaccatcactggggctcgggcggaagatgaggctgactattactgtcagtcccgggacagcagtggtaaccagctggtgttcggcagagggacgaagctgatcgtcctag

SEQ ID NO: 7997 - DNA, 322 bp, Artificial Sequence
  Synthetic construct
gacatccagatgacccagtctccttccaccctgtctgcatctgtaggagacagagtcaccttcacttgccgggccagtcagagtattgatagctggttggcctggtatcagcagaaaccagggaaagcccctaaactcctgatctataaggcgtctagtttacaaagtggggtcccatcacggttcagcggcagtggatctgggacagaattcactctcaccatcagcagcctgcagcctgatgattttgcaacttattactgccaacagtataatacttattcgtacacttttggccaggggaccaagctggagatcaagc

SEQ ID NO: 7998 - DNA, 322 bp, Artificial Sequence
  Synthetic construct
gacatccagatgacccagtctccttccaccctgtctgcatctgtaggagacagagtcaatatcacttgccgggccagtcagagtattagtagctggttggcctggtatcagcagaaaccagggaaagcccctaacctcctcatctatagggcgtctaggttacaaagtggggtcccaccaaggtttagcggcagtggatctgggacagaattcacactcaccatcagcagtctgcagcctgatgattttgcaacttattactgccaacagtataaaagttattcgtggacgttcggccaagggaccaaggtggaaatcaaac

SEQ ID NO: 7999 - DNA, 325 bp, Artificial Sequence
  Synthetic construct
tactatgtgctgactcagccaccctcggtgtcagtggccccaggacagacggccaggatcacctgcgggggaaacaacattggaagtagaagtgtgcactggtaccaccagaagccaggccaggcccctgtgctggtcgtctatgatgatagcgaccggccctcagggatccctgagcgattttctggctccaactctgggaacacggccaccctgaccatcagcagggtcgaggccggggatgaggccgactattactgtcagatttgggatattgacagtgatcattgggtgttcggcggagggaccaagctgaccgtcctag

SEQ ID NO: 8000 - DNA, 331 bp, Artificial Sequence
  Synthetic construct
cagtctgccctgactcagcctcgctcagtgtccgggtctcctggacagtcagtcaccatctcctgcactggaaccagcagtgatgttggtggttataactatgtctcctggtaccaacaacacccaggcaaagcccccaaactcatgatttataatgtcagtcagcggccctcaggagtccctcatcgtttctctggctctaagtctggcaacacggcctccctgaccatctctgggctccaggctgacgatgaggctgactattactgctgctcatatgcaggcagttacacttttctcttcggaactgggaccaaggtcaccgtcctag

SEQ ID NO: 8001 - DNA, 322 bp, Artificial Sequence
  Synthetic construct
tcccatgtgctgactcagccaccctcggtgtcagtggccccaggacagacggccaggattacctgtgggggagacaacattgggagtcaaagtgtgcactggtaccagcagaagccaggccaggcccctgtgctggtcgtctatgatgatagcgaccggccctcagggatccctgagcgattctctggctccaactctgggaactcggccaccctgaccatcagcagggtcgaggccggggatgaggccgactactactgtcaggtgtggaatagtattagtgattatgtcttcggaactgggaccaaggtcaccgtcctag

SEQ ID NO: 8002 - DNA, 334 bp, Artificial Sequence
  Synthetic construct
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgccgtggtattcggcggacagaccaagctgaccgtcctag

SEQ ID NO: 8003 - DNA, 334 bp, Artificial Sequence
  Synthetic construct
cagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcaggtgttcggcggagggaccaagctgaccgtcctag

SEQ ID NO: 8004 - DNA, 322 bp, Artificial Sequence
  Synthetic construct
gccatccggatgacccagtctccatcctcactctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagtggcagtggatctgggacagatttcactctcaccatcagctgcctgcagtctgaagattttgcaacttattactgtcaacagtattatagttaccctccgacgttcggccaagggaccaaggtggaaatcaaac

SEQ ID NO: 8005 - DNA, 322 bp, Artificial Sequence
  Synthetic construct
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagcggcagtggatctgggacagatttcactctcaccatcagcagcctgcagcctgaagatgttgcaacttattactgtcaaaagtataacagtgccccattcactttcggccctgggaccaaagtggatatcaaac

SEQ ID NO: 8006 - DNA, 227 bp, Artificial Sequence
  Synthetic construct
ggggtatcagcaagtcccaggatcggcccccaaagtcctcatgtatagggattctcaacggcccacaggggtccccgaccgattcctcggctccaactctggcacctcagcctccctggccatcagtgacctccagactgacgatgaggctgattattactgtgcagtttgggatgacaacctgagggcttgggtgttcggcggagggaccaagttgaccgtcctag

SEQ ID NO: 8007 - DNA, 325 bp, Artificial Sequence
  Synthetic construct
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatcgggtattcggcggagggaccaagctgaccgtcctag

SEQ ID NO: 8008 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcttcggacgttcggccaagggaccaaggtggaaatcaaac

SEQ ID NO: 8009 - DNA, 328 bp, Artificial Sequence
  Synthetic construct
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgaccctttcgggtgcgcagcctgaggatgaggctgagtattactgcttgctctcctatagtggtgcttgggtgttcggcggagggaccaagctgaccgtcctag

SEQ ID NO: 8010 - DNA, 322 bp, Artificial Sequence
  Synthetic construct
gccatccagatgactcagtctccatcctccctgtctgcatctgtaggagacagagtcaccatcacttgccgggcaagtcagaccattactaggtctttgaattggtatcagcagagacccgggaaagcccctcaactcctgatctattctacatccagtttgccgagtggggtcccatcaagattcactggcagtggatctgggacagatttcactctcaccatcagcagtctgcaacctgaagattttgcaacttactactgtcaacagacttacagtgccccgtacacttttggccaggggaccaaactggagatcaaac

SEQ ID NO: 8011 - DNA, 325 bp, Artificial Sequence
  Synthetic construct
tcctatgacctgacacagccaccctcggtgtcagtgtccccacgacagacggccacgatcacctgctctggagatgcattgccaaatcaacatgtttcttggtaccagcagaaggcaggccaggcccctgtgttggtgatatataaagacactgagaggccctcagggatccctgagcgattctctggctccacctcagggacaacagtcacgttgaccataagtggagtccaggcagaagacgaggctgactattattgtcaatcagcagacagcagtggtctttattatgtcttcggaagtgggaccacagtcaccgtcctaa

SEQ ID NO: 8012 - DNA, 325 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaagccagggaaagcccctaagctcctgatctatgctgcatccactttgcaaagtggggtcccatcaaggttcagtggcagtggatctgggacagatttcactctcaccatcagcagtctccaacctgaagattttgcaacttactactgtcaacagagttacagtacccccctgtacacttttggccaggggaccaagctggagatcaaac

SEQ ID NO: 8013 - DNA, 322 bp, Artificial Sequence
  Synthetic construct
gccatccagatgacccagtctccatcctccctgtctgcatctgtaggagacagagtcaccatcacttgccgggcaagtcagggcattagaaatgacttaggctggtatcagaagaagccagggaaagcccctaagctcctgatctatgctgcatccagtgtccaaagtggggtcccatcgaggttcagcggcagtggatctggcacagatttcactctcaccatcagcagcctgcagcctgaagattttgcaacttattactgtctacaagattacaattaccctcgaacgttcggccaagggaccaaggtggaaatcaaac

SEQ ID NO: 8014 - DNA, 322 bp, Artificial Sequence
  Synthetic construct
caaattgtgttgacacagtctccagccaccctatctttgtctccaggggaaaaagccaccctctcatgcagggccagtcagagtgttaggaattacttagcctggcaccaacagaaacctggccaggctcccaggctcctcatctatgatgcctccaccagggccattgacatccccgccaggttcagtggcagtgggtctgggacagacttcactctcaccatcagcggcctggagcctgaagattttgcagtttattattgtcagcagcgtagcaactggccggagacttttggccaggggaccaagctggagatcaatc

SEQ ID NO: 8015 - DNA, 325 bp, Artificial Sequence
  Synthetic construct
gaaattgtgttgacacagtctccagccaccctgtctttgtctccgggggaaagagccaccctctcctgcagggccagtcagagtgttaacaccgacttagcctggtaccaacagaggcctggccaggctccccggctcctcatctatactgcatccaacagggccactggcatcccagccaggttcagtggcagtgggtctgggacagacttcactctcaccatcagcagccttgagcctgaagattttgcagtttattactgtcagcagcgtagcaactggcctccgatcaccttcggccaagggacacgattggagattaacc

SEQ ID NO: 8016 - DNA, 325 bp, Artificial Sequence
  Synthetic construct
tcttctgagctgactcaggaccctgctgtgtctgtggccttgggacagacagtcaggatcacatgccaaggagacagcctcagaagctattctccaagctggtaccagcagaagccaggacaggcccctgtacttgtcatctatggtaaaaacaaccggccctcagggatcccagaccgattctctggctccagctcaggaaacacagcttccttgaccatcactggggctcaggcgaaagatgaggctgactattactgtaactcccgggacagcagtggcaagcatctgctattcggcggagggaccaagctgaccgtcctag

SEQ ID NO: 8017 - DNA, 331 bp, Artificial Sequence
  Synthetic construct
aattttatgctgactcagccctactctgtgtcggagtctccggggaagacggtaaccatctcctgcacccgcagcagtggcagcattgccaacaactatgtgcagtggtaccagcagcgcccgggcagtgcccccaccacagtgatctatgaggattaccaaagaccctctggggtccctgatcggttctctggctccatcgacacctcctccaactctgcctccctcaccatctctggactgaagactgaggacgaggctgactactactgtcagtcttatgatagtacttatagggtgttcggcggagggaccaagctgaccgtcgtag

SEQ ID NO: 8018 - DNA, 328 bp, Artificial Sequence
  Synthetic construct
tcttctgagctgactcaggaccctgctgtgtctgtggccttgggacagacagtcacgatcacctgccaaggagacagcctcgaaagctattatgcaacctggtaccagcagaggccaggacaggcccccatacttgtcctctatggtaaaaacaatcggccctcagggatccccgaccgattctctggctccagctcaggaaccacagcttccttgaccatcactggggctcaggcggaagatgaggctgactattactgtaattcccgggacatgagtggtaaccatctgggggtcttcggaactgggaccaaggtcaccgtccttg

SEQ ID NO: 8019 - DNA, 322 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcatctagtttagaaagtggggtcccatcaaggttcagcggcagtggatctgggacagaattcactctcaccatcagcagcctgcagcctgatgattttgcaacttattactgccaacagtataatagttattctcagacgttcggccaagggaccaaggtggaaatcaaac

SEQ ID NO: 8020 - DNA, 328 bp, Artificial Sequence
  Synthetic construct
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatccgggggtattcggcggagggaccaagctgaccgtcctag

SEQ ID NO: 8021 - DNA, 322 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcatctagtttagaaagtggggtcccatcaaggttcagcggcagtggatctgggacagaattcactctcaccatcagcagcctgcagcctgatgattttgcaacttattactgccaacagtataatagttattctcggacgttcggccaagggaccaaggtggaaatcaaac

SEQ ID NO: 8022 - DNA, 325 bp, Artificial Sequence
  Synthetic construct
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgccctttatgtcttcggaactgggaccaaggtcaccgtcctag

SEQ ID NO: 8023 - DNA, 322 bp, Artificial Sequence
  Synthetic construct
gccatccggataacccagtctccatcctcactctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttacccgctcactttcggcggagggaccaaggtggagatcaaac

SEQ ID NO: 8024 - DNA, 322 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtgccagtgggtctgggacagagttcactctcaccatcagcagcctgcagtctgaagattttgcagtttattactgtcagcagtataataactggcctccgacgttcggccaagggaccaaggtggaaatcaaac

SEQ ID NO: 8025 - DNA, 274 bp, Artificial Sequence
  Synthetic construct
tcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaagctgaccgtcctag

SEQ ID NO: 8026 - DNA, 325 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgtacacttttggccaggggaccaagctggagatcaaac

SEQ ID NO: 8027 - DNA, 325 bp, Artificial Sequence
  Synthetic construct
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccattatgtcttcggaactgggaccaaggtcaccgtcctag

SEQ ID NO: 8028 - DNA, 322 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaaacccctaagctcctgatctataaggcatctagtttagaaagtggggtcccatcaaggttcagcggcagtggatctgggacagaattcactctcaccatcagcagcctgcagcctgatgattttgcaacttattactgccaacagtataatagttatctattcactttcggccctgggaccaaagtggatatcaaac

SEQ ID NO: 8029 - DNA, 322 bp, Artificial Sequence
  Synthetic construct
gacgtccagatgacccaatctccatcttccgtgtctgcatctgtaggagaccgagtcaccatcacttgtcgggcgagtcaaagtatcagtaactgggtagcctggtatcagcagaaagcagggaaagcccccaagctcctgatctctggtgcatccagtttgcaaagtggggtcccatcaagattcagcggcagtggatctgggacagatttcactctcaccatcaccagtctgcaggctgaagactctgcaacttactattgtcaacaggccaacagtttcccgctctctttcggcggagggaccaaggtggagatcaccc

SEQ ID NO: 8030 - DNA, 322 bp, Artificial Sequence
  Synthetic construct
gaagttctcttgacacagactccagccaccctgtctttgtctccaggggagagagccaccctctcctgcagggccaatcaaagtgttggcacctacttagtctggtaccaacagaaacctggccaggctcccagggtcgtcatctctgatgcatccaaccgggccactggcctcccagccaggttcagtggcagtgggtctgggacggatttcactctcaccatcagcagcctagagcctgacgattttgcagtttattactgtcagcaccgcagcacctggcctccgacgttcggccaggggaccaaggtggaaatcaaac

SEQ ID NO: 8031 - DNA, 310 bp, Artificial Sequence
  Synthetic construct
gccatccagttgacccagtctccatccttcctgtctgcatctgtaggagacagagtcaccatcacttgccgggccagtcgggacattaggagttatttagcctggtatcagcaaaaaccagggaaagcccctaagctcctgatctatgctgcatccactttgcaaagtggggtcccatcaaggttcagcggcagtggatctgggacagagttcactctcacaatcagcagcctgcagcctgaagattttgcaacttattactgtcaacaccttaggacgttcggccaagggaccaaggtggaaatcaaac

SEQ ID NO: 8032 - DNA, 331 bp, Artificial Sequence
  Synthetic construct
cagtctgccctgactcagcctgcctccgtgtctgggtctcctggacagtcgatcaccatctcctgcactggaaccagcagtgatgttgggagttataaccttgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgactctgattattactgctgctcatatgcaggtagtagtacttatgtcttcggaactgggaccaaggtcaccgtcctag

SEQ ID NO: 8033 - DNA, 322 bp, Artificial Sequence
  Synthetic construct
aaaatagtgatgacgcagtctccagccaccctgtctgtgtctccaggggagagagccacgctctcctgcagggccagtcagagtgtcagcagcgacttagcctggtaccagcagaagcctggccaggctcccaggctcctcatctatggtgcatccaccagggccactggtatcacagccaggttcagtggcagcgggtctgggacagagttcactctcaccatcagcagcctgcagtctgaggattttgcagtttattactgtcagcaatatcatagctggccgggcacttttggccgggggtccaagctggagatcgaac

SEQ ID NO: 8034 - DNA, 322 bp, Artificial Sequence
  Synthetic construct
gacatccagatgacccagcctccttccaccctgtctgcatctgtaggagacagagtcagcatcacttgccgggccagtcagaatattggtaactggttggcctggtatcagcagaaaccagggaaagcccctaaactcctgatctatcaggcatctagtttagagggtggggtcccatcaagattcagcggcagtagatctggtacagaattcactctcaccatcagcggcctgcagtctgatgattttgcaacttattactgccatcaatataatagttatccgacaacattcggccaagggaccaaggtggaaagcagac

SEQ ID NO: 8035 - DNA, 92 bp, Artificial Sequence
  Synthetic construct
gactgacgatgaggctgattattactgtgcagtttgggatgacaacctgagggcttgggtgttcggcggagggaccaagttgaccgtcctag

SEQ ID NO: 8036 - DNA, 322 bp, Artificial Sequence
  Synthetic construct
gacatccagatgacccagtctccttccaccctgtctgcatctgtaggggacagaatcaccatcacttgccgggccagtcagagcattggaagctggttggcctggtatcagcagagaccagggaaagcccctaaagtcctgatctataaggcgtctattttagaaagtggggtcccatccacattcagcggcagtggatctgggacagaattcactctcaccatcaccagcgtgcagcctgatgattctgcaacttattactgccaacactatgataattatccgtggacgttcggccaagggaccaaggtggagatcaaac

SEQ ID NO: 8037 - DNA, 325 bp, Artificial Sequence
  Synthetic construct
tcctatgtgctgactcagccaccctcggtgtcagtggccccaggacagacggccagaattacctgtgaggcagacaacattggaagtaaaagtgtgcactggtaccagcagaagtcaggccaggcccctgtggtggtcgtgtatcatgatagcgaccggccctcggggatccctgagcgattttctggctccaactctggtaacacggccaccctgaccatcagcagggtcgaggccggggatgaggccgactatttctgtcaggtgtgggataacaatagtgaacatgaagtcttcggaactgggaccaaggtcaccgttctgg

SEQ ID NO: 8038 - DNA, 325 bp, Artificial Sequence
  Synthetic construct
gacatgcagatgacccagtctccttccaccctgtctgcatttgtaggagacagagtcaccatcacttgccgggccagtcagagtattggcacgtggttggcctggtatcagcacaaaccagggacagcccctattctcctaatttataaggcatctaccttaaaaagtggggtcccatcaaggttcagcggcagtggatcagggacagaattcactctcaccatcagaagcctgcagcctgatgattttggaacttactactgccaacaatatgatagtcgttttccgtacacttttggccaggggaccaagctggagatcaaac

SEQ ID NO: 8039 - DNA, 331 bp, Artificial Sequence
  Synthetic construct
cagtctgtgctgactcagccaccctcagcgtctgggacccccgggcagagggtcaccatctcttgttctggaagcagctccaacgtcggaagtaatactgtaaactggtaccagcagctcccaggaacggcccccaaactcctcatctataataataatcagcggccctcaggggtccctgaccgattctctggctccaagtctggcacctcagcctccctggccatcagtggactccagtctgaggatgaggctgattattactgtgcagcatgggatgacagcctgaatggtccggtcttcggaactgggaccaaggtcaccgtcctag

SEQ ID NO: 8040 - DNA, 328 bp, Artificial Sequence
  Synthetic construct
gaattagtgatgacgcagtctccagccaccctgtctgtgtctccaggggagagagccaccctgtcctgcagggccagtcagagtgtttcccacaacttagcctggtaccagcagatacctggccaggctcccaggctcctcatctatggtgcatccaccagggccactggtatcccagccaggttcagtggcagtgggtctgggacagagttcaatctcaccatcagcagcctgcagcctgaagattttgcagtttattactgtcagttgtataataactggcctcggagaatcactttcggccctgggaccaaagtggatgtcaaac

SEQ ID NO: 8041 - DNA, 182 bp, Artificial Sequence
  Synthetic construct
cactggaaccagcagtgacattgggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 8042 - DNA, 319 bp, Artificial Sequence
  Synthetic construct
gacatccagatgacccagtctccttccattctgtctgcttctgtaggggatagagtcaccatcacttgccgggccaaccagagtgttggtatctggttggcttggtatcagcagaaaccgggaaaaggccctagtctcctaatatataagacgtctactttacaaagtggggtcccatcaaggttcagcggcagtggatctgggacagaattcactctcaccatcagcagcctgcagcctgatgattttgcaatttattattgccaacattataatacttatagggcgttcggcctagggaccaaggtggaaatcaaac

SEQ ID NO: 8043 - DNA, 340 bp, Artificial Sequence
  Synthetic construct
gacatcgtgatgacccagtctccagactccctgcctgtgtctctgggcgagagggccaccatcaactgcaagtccagccagagtgttttcttcagctccaacaataggaactacttagcttggtatcagcaaagaccaggacagcctcctaacctcctcatttactgggcatctacccgggattccggggtccctgaccgattcagtggcagcgggtctgggacagatttcactctcaccatcagcagcctgcaggctgaagatgtggcagtttatttctgtcagcaatactatactactccgtacacttttggccaggggaccaagctggagatcaaac

SEQ ID NO: 8044 - DNA, 325 bp, Artificial Sequence
  Synthetic construct
tcttctgagttggcccaggaccctgctgtgtctgtggccttggggcacacagtcacgatcacatgccgaggagacttcggcagcagttcttatgagagttggtaccgacagaagccgggacaagccccactcactgtcctgtatggaagatacatccggccctcagggatctcagaccgattccatggctccacagttggaaacacagcttccctgcatatcgccggggttcaggcggacgatgagggcacttatttctgttgcgcaatggacgtcaggagtcaccaggtgaaattcggcggcgggaccaagctcattgtcctaa

SEQ ID NO: 8045 - DNA, 322 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcatctagtttagaaagtggggtcccatcaagattcagcggcagtggatctgggacagaattcactctcaccatcagcagcctgcagcctgatgattttgcaacttattactgccaacagtataatagttatctgtggacgttcggccaagggaccaaggtggaaatcaaac

SEQ ID NO: 8046 - DNA, 331 bp, Artificial Sequence
  Synthetic construct
cagtctgccctgactcagcctgcctccgtgtctgggtctcctggacagtcgatcaccatctcctgcactggaagcagcagtgacgtcggttattataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcgggtcttcggaagtgggaccgaggtcaccgtcctag

SEQ ID NO: 8047 - DNA, 328 bp, Artificial Sequence
  Synthetic construct
tcttctgagttgactcaggaccctgctgtgtctgtggccttgggacagacagtcaggatcacatgccaaggagacagcctcagaaggtattatgcaacgtggtaccaacagaagccaggacaggcccctgtacttgtcatgtataataaggacaatcggccctcagggatcccagaccgattctctggctccagctcagggaacacagcttccttgaccatcactggggctcaggcggaagatgaggctgactattactgtaactcctgggacaccagtggtaactatcccgtgatattcggcggagggaccaaactgaccgtcctag

SEQ ID NO: 8048 - DNA, 156 bp, Artificial Sequence
  Synthetic construct
tttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 8049 - DNA, 319 bp, Artificial Sequence
  Synthetic construct
gaaattgtgatgacgcagtctccagtcacgttgtctgtgtctccgggggaaagagtcgcgctctcctgcagggccagtcagagtgtcagcagcaacttagcctggtaccagcaaaaacctggccaggctcccacactcctcatctatggtgcatctctcagggccactggtgtcccagccaggttcagtggcagtgggtctgggacgcagttcactctcactatcagcagcctgcagtctgaagatttagccgtgtattactgtcaccaatatgacaccatgtacacttttggccaggggaccaagctggagatcaaac

SEQ ID NO: 8050 - DNA, 337 bp, Artificial Sequence
  Synthetic construct
cagtctgtgctgacgcagccgccctcagtgtctggggccccagggcagagggtcaccatctcctgcactgggagcagctccaacatcggggcaggttatgatgtacactggtaccagcaccttccaggaacagcccccaaactcctcatctatggtaacatcaatcggccctcaggggtccctgaccgattctctggctccaagtctggcacctcagcttccctggccatcactgggctccaggctgaggatgaggctgattattactgccagtcctatgacagcagcctgagtgtcttttatgtcttcggaactgggaccaaggtcaccgtcctag

SEQ ID NO: 8051 - DNA, 325 bp, Artificial Sequence
  Synthetic construct
gaaattgtgttgacgcagtctccaggcaccctgtctttgtctccagggggaagagccggtctctcctgcagggccagtcagagtgtttctaacgactacttagcctggtaccagcagagacctggccaggctcccaggctcctcatctatggtgcttccaccagggccactggcatcccagacaggttcggtggcagcgggtctgggacagacttcactctcaccatcagcagactggagcctgaagattttgcagtctatttctgtcaacagtatggcagttcgcctcagacgttcggccaagggaccaaagtagaaatcaatc

SEQ ID NO: 8052 - DNA, 325 bp, Artificial Sequence
  Synthetic construct
ccctatgtgctgacgcagccaccctcggtgtcagtggccccaggacagacggccaggactacctgtgggggaaactacattgaaagtaaaagtgtgcactggtaccagcagaagccaggccaggcccctgtgttggtcctctctgatgataccgaccggccctcagggatccctgagcgattctctggctccagctctggcaacacggccaccctgatcatcagcgcggtcgaggccggggatgaggccgactattactgtcaggtgtgggatagtactggcgatcatgtggtcttcggcggagggaccaagctgaccgtcctag

SEQ ID NO: 8053 - DNA, 322 bp, Artificial Sequence
  Synthetic construct
gacatccagatgacccagtctcctttcaccctgtctgcatctgtcggcgacagaatcaccatcacttgccgggccagtcagagtattaatagttggttggcctggtttcagcagaaaccagggaaagcccctaaactcctgatctatcagtcatcttctttagaaaatggggtcccatcaagattcagcggcagtgggtctgggacagacttcactctcaccatcagtagtctagagcctgaggattttgcagtttattactgtcagcagcgtggcgactggcctccgaccttcggccaagggaccaaggtggaaatcagac

SEQ ID NO: 8054 - DNA, 322 bp, Artificial Sequence
  Synthetic construct
gatattgtgttgacacagtctccagccaccctgtctttgtctccaggagaaagagccaccctctcctgcagggccagtcagaatgttgacagttatttagcctggtaccaacagaaacctggccagtctcccagattcctcatctatgatgcgtccagcagggccactggcgtcccagccaggttcagtggcagtgggtctgggacagacttcactctcaccatcagtagtctagagcctgaggattttgcagtttattactgtcagcagcgtggcgactggcctccgaccttcggccaagggaccaaggtggaaatcagac

SEQ ID NO: 8055 - DNA, 122 bp, Artificial Sequence
  Synthetic construct
cccctccacgacgctcttccgatctctcacactcctgcaggccgctgattattactgcacctcatatacaaacgacagcaattctcaggtattcggcggagggaccaagctgaccgtcctag

SEQ ID NO: 8056 - DNA, 337 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgatgtggtattcggcggagggaccaagctgaccgtcctag

SEQ ID NO: 8057 - DNA, 328 bp, Artificial Sequence
  Synthetic construct
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagctctgtggtattcggcggagggaccaagctgaccgtcctag

SEQ ID NO: 8058 - DNA, 322 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactcactttcggcggagggaccaaggtggagatcaaac

SEQ ID NO: 8059 - DNA, 319 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcgtttcggcggagggaccaaggtggagatcaaac

SEQ ID NO: 8060 - DNA, 322 bp, Artificial Sequence
  Synthetic construct
gaaatagtgatgacgcagtctccagccaccctgtctgtgtctccaggggaaagagccaccctctcctgctgggccagtcagagtgttggcagcaatttagcctggtaccagcacaaatctggccggcctcccaggctcctcatctatggtgcatcgaccagggccgctggtatcccagccaggttcagtggcagtgggtctgggacagagttcactctcaccatcagcagcctgcagtctgaagatcttgcagtttatgactgtcaacagtataataactggcctcgaacgttcggccaagggaccaaggtggaaatcaaac

SEQ ID NO: 8061 - DNA, 331 bp, Artificial Sequence
  Synthetic construct
cagtctgttttggcgcagccgccctcagtgtctgcggccccaggacagagggtcaccatctcctgctctggaagcaactccaacattggatataattctgtatcctggtaccagcagttcccaggaacagcccccaaactcctcatttatggcaataacaatcgacagtcagggattcctgaccgattctctggctccaagtctggcacgtcagccaccctggacatcaccggactccagactgcggacgaggccgattattactgcggaacatatgatcgcagcctgagtgcttgggtgttcggcggagggaccaagctgaccgtcctag

SEQ ID NO: 8062 - DNA, 334 bp, Artificial Sequence
  Synthetic construct
cagtctgccctgactcagcctgcctccgtgtctgggtctcctggacagtcgatcaccatctcctgcactggaaccaacagtgatgttgggaattataaccttgtctcctggtaccaaaaccacccaggcaaagcccccaaagtcttgatttatgagggcagtaagcggccctcaggggtttctaatcgcttctctggctccaagtctggcacgtcagccaccctggacatcaccggactccagactgcggacgaggccgattattactgcggaacatatgatcgcagcctgagtgcttgggtgttcggcggagggaccaagctgaccgtcctag

SEQ ID NO: 8063 - DNA, 331 bp, Artificial Sequence
  Synthetic construct
cagtctgtgttgacgcagccgccctcagtgtctgcggccccaggacagaaggtcaccatctcctgctctggaagcaactccaacattggaaataattatgtctcctggtatcagcaactcccaggaaaagccccccgactcctaatttatgacagtaataagcgaccctcagagattcctgaccgattctctggctccaagtctgacacgtcaggcaccctggacatcaccggactccagaccggggacgaggccgattattactgcggaacatgggatgccgaattgagagcgagggtgttcggcggagggaccagactgaccgtcctag

SEQ ID NO: 8064 - DNA, 331 bp, Artificial Sequence
  Synthetic construct
tcctatgtactgactcagccaccctcggtgtcagtggccccaggacagacggccaggattacctgtgggggaagcaacatcgaaactaaacctgtgcactggtaccggcagaggtcaggccaggcccctgtactggtcgtctatgatgatagcgaccggccctcagggattcctgagcgagtgtctggctccaactttgggaacacggccaccctgaccatcaccacggtcgaagccggggatgaggccgactacttctgtcaggtgtgggatagcagtagtgatcctccgtgtgtggtgttcggcggagggaccaagctgaccgtcctac

SEQ ID NO: 8065 - DNA, 322 bp, Artificial Sequence
  Synthetic construct
gacatccagatgacccagtctccatcctccctgtcagcctctgtaggagacagagtcaccatcacttgccgggcaagtcagagcattggcacctatttaaattggtatcggcagaaaccagggaaagcccctaagctcctcatctatgctgcatccactttgcagagtggggtcccatcaaggctcagtggcagtggatctgggacagaattcactctcaccatcaccagtctgcaacctgaagactttgcagcttactactgtcaacagagttacaatatcccgtacacctttggccaggggaccaagctggagatcagac

SEQ ID NO: 8066 - DNA, 328 bp, Artificial Sequence
  Synthetic construct
gagattgtgttgacgcagtctccaggcaccctgtctttgtctccaggtgaccgagccaccatctcctgtagggccagtcagcatgttcgcacgaccatgttggcctggtatcaacaaaaacctggccagtctcccaccctcctcatctatggtgtgtccgacagggccactggcatcccagacaggttcagaggcagtggctatgggacagagttcactctcaccatcaccagactggagcctgaagactttgccgtatattactgtcaacactatgcttactcaccaccgtggacgttcggccaagggaccagggtggaagtcaaac

SEQ ID NO: 8067 - DNA, 316 bp, Artificial Sequence
  Synthetic construct
gacatccagatgacccagtctccttccaccctgtctgcatctgtaggggacagagtcaccatcacttgccgggccagtcggagtgttagtggctggttggcctggtatcagcagaaaccagggaaagcccctaagctcctgatctatgaggcgtctcatttaggaggtggggtcccatcgaggttcagcggcagtggatttgggacagaattcacgctcaccatcagcagcctgcagcctgatgattttgcgatttattactgccaacagtataatagttacacttttggccaggggaccaagttggagatcaaac

SEQ ID NO: 8068 - DNA, 331 bp, Artificial Sequence
  Synthetic construct
cagtctgccctgactcagcctgcctccgtgtctgggtctcctggacagtcgatcaccatctcctgcactggaaccagcagtgacgttgatgattataagtttgtctcctggtaccaacaacacccaggcaaagcccccaaagtcatgatttatgaagtcagtaatcgggccccaggggtttctaatcgcttctctggctccaagcttggcaacacggcctccctgaccatctctgggctccagactgaggacgaggctgattatttctgcagctcatatacaaccaggattccttgtgtcttcggagctgggaccaaggtcaccgtcctag

SEQ ID NO: 8069 - DNA, 334 bp, Artificial Sequence
  Synthetic construct
cagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaaacttgatggtagtggaagctacaacaaggggagcggagttcctgatcgcttctcaggctccagctctggggctgaccgctacctcaccatctccaacctccagtctgaggatgaggctgatttttactgtgagacctgggacagttacactcaggtgttcggcggagggaccaagctgaccgtcctag

SEQ ID NO: 8070 - DNA, 340 bp, Artificial Sequence
  Synthetic construct
gacatcgtgatgacccagtctccagactccctgtctgtgtctctgggcgagagggccaccatcaactgcaagtccagccagagtgtcttatatggctccagcaataagaactacttagcttggtatcagcagaaaccaggacagcctcctaagcttctccttaactgggcatctacccgggaatttggggtccctgaccgattcagtggcagcgggtctgggagagatttcactctcaccatcagcagcctgcaggctgaagatgtggcagtttattactgtcagcaatattttaattctcccatcaccttcggccaagggacacgactggagattaaac

SEQ ID NO: 8071 - DNA, 322 bp, Artificial Sequence
  Synthetic construct
gacatccagatgacccagtctccttccaccctgtctgcatctgtaggagacagagtcaccatcacttgccgggccagtcagagtattagttcctggttggcctggtatcagcaaaaaccagggaaagcccctaagctcctgatctataaggcgtctactttagaaagtggggtcccatcaaggttcagcggcagtggatctgggacagaattcactctcaccatcagcagcctgcagcctgatgattttgcaacttattactgccaacaatataatagttacatgtacacttttggccaggggaccaagctggagatcaaac

SEQ ID NO: 8072 - DNA, 322 bp, Artificial Sequence
  Synthetic construct
gacatccagatgacccagtctccatcctccctgtcggcatctgtaggagacagagtcaccatcacctgccgggcgagtcagggcattagcaattatttagcctggtatcagcagaaaccagggaaggcccctaacctcctgatctatgctgcatccactttgcaatctggggtcccatctcggttcagtggcagtggatctgggacagatttcactctcaccatcagcagcctgcagcctgaggatattgcaacttattactgtcaaaagtataaccgtgccccccacacttttggccaggggaccaacgtggagatcaaac

SEQ ID NO: 8073 - DNA, 322 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaaactcctgatctataaggcgtctactttagaaagtggggtcccatcaaggttcagcggcagtggatctgggacagaattcactctcaccgtcagcagcctgcagcctgatgattttgcaacttattactgccaacagtataatagttattcgtggacgttcggccaagggaccagggtggaaatcaaaa

SEQ ID NO: 8074 - DNA, 322 bp, Artificial Sequence
  Synthetic construct
gtcatccagatgacccagtctccatcctcactgtctgcgtctgtaggagacagcgtcaccatcacttgccgggcgagtcaggacattagcaattatttagcctggtttcagcagaaaccagggagagcccctaagtccttgatctctggagcgtcaagtttgcacgggggggtctcatcaaggtttggtggcagtggatccgggacagaattcactctcaccatcaacagcctgcagcctgaagattttgcaacttattactgccaacagtatgatagttatcctcgaacgttcggccaggggaccacggtggaaatcaaag

SEQ ID NO: 8075 - DNA, 322 bp, Artificial Sequence
  Synthetic construct
gacatccagatgacccagtctccttccaccctgtctgcatctgtaggagacagagtcaccatcacttgccgggccagtcagagtattagtgcctggctggcctggtatcagcagaaaccggggaaagcccctaaactcctgatctctggggcctctaatttggagtatggggtccctgcaaggttcagcggcagtggatctgggacacacttcactctcaccatcaggagcctgcagcctgatgattttgcaacttattactgccaacaatataatatctatccggaaacgttcggccaagggaccagggtggaaatcagac

SEQ ID NO: 8076 - DNA, 325 bp, Artificial Sequence
  Synthetic construct
caaattgtgttgacacagtctccagccaccctgtctttgtctccaggggaaagagtcaccctctcctgcagggccagtcagagtattagaagctacttagcctggtaccaacagaaacctggccaggctcccagcctcctcatctttggtgcatccaacagggccactggcgtcccagccaggttcagtggcagtgggtctgggacagacttcactctcaccatcagcagcctagagcctgaagattttgcagtttattactgtcagcaccgtagcaactggcctccgtacacttttggccaggggaccaagctggagatcaaac

SEQ ID NO: 8077 - DNA, 331 bp, Artificial Sequence
  Synthetic construct
caggctgtggtgactcaggagccctcgctgactgtgtcccctggagggacagtcactctcacctgtggctccagcactggagctgtcaccagtggtcattatccctactggttccagcagaaacctggccaagcccccaggactctaatttatgatacaactaacagaaactcctggacacctgcccggttctcaggctccctccttgggggcaaagctgccctgaccctttcgggtgcgctgcctgacgatgaggctgaatattactgcttactcgcctttggtggtgtccggtgggtgttcggcggagggaccaagctgaccgtcctag

SEQ ID NO: 8078 - DNA, 334 bp, Artificial Sequence
  Synthetic construct
cagtctgccctgactcagcctgcctccgtgtctgggtctcctggacagtcgatcaccatctcctggaatggaaccagcagtgacgttggtggttataactatgtctcctggtaccaacaaaacccaggcaaagcccccaaagtcatgatttatgatgtcagtaatcggccctcagggatttctaatcgcttctctggctccaagtctggcaacacggcctccctgaccatctctgggctccaggctgacgacgaggctgattattactgcacctcatatacaaacgacaccaattctcaggtattcggcggagggaccaagctgaccgtcctag

SEQ ID NO: 8079 - DNA, 334 bp, Artificial Sequence
  Synthetic construct
cagtctgtgctgacgcagccgccctcagtgtctggggccccagggcagagggtcaccatctcctgcactgggagcagttccaacatcggggcagcttatgatgtacactggtaccagcaccttccaggaacagcccccaaactcctcatctatgctaacagcaatcggccctcaggggtccctgaccgattctctggctccaagtctggcacctcagcctccctggccatcactgggctccaggctgaggatgaggctgattattactgccagtcctatgacagccgcctgagtggttatgtcttcggaaccgggaccaaggtcaccgtcctag

SEQ ID NO: 8080 - DNA, 319 bp, Artificial Sequence
  Synthetic construct
gacatccagatgacccagtctccatcctccctgtctgcatctgtaggagacagagtcaccatcacttgccaggcgagtctggacatcagcaactttttaaattggtatcagcagaaaccagggaaagcccctaaactcctgatctacgatacatccaatttggaaagaggggtcccatcaaggttcagtggaagtggatctgggacagattttaatttaaccatcaccagcctgcagcctgaagatattgcaacatattactgtcaacagtatgataatctgatcaccttcggccaagggacacgtctggagattaaac

SEQ ID NO: 8081 - DNA, 319 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcaactttcggcggagggaccaaggtggagatcaaac

SEQ ID NO: 8082 - DNA, 322 bp, Artificial Sequence
  Synthetic construct
gacatccagatgacccagtctccttccaccctgtctgcatctataggagacagagtcaccatcacttgccgggccagccacagtattagttcgtggttggcctggtatcagcacaaaccagggaaagcccccaagctcctgatctataaggcgtctactttagaaagtggggtcccatctaggttcagcggcagtggctctgggacagaattcactctcaccatcagcagcctgcagcctgatgattttgcaacttatttctgccaacaatataatagtgtcttatacacttttggccaggggaccaagctggagatcaaac

SEQ ID NO: 8083 - DNA, 337 bp, Artificial Sequence
  Synthetic construct
gacattgtgatgactcagaccccgctctccctgtccgtcacccttggacaggcggcctccttctcctgcacgtctagtcaaagtgtcgttcgcagtgatgggatcacctacttgagctggtttcaccagaggccaggccaatctccaaggcgcctgatttatatggtttctaaccgggactctggggccccggacagattcagcggcagtgggtcagtcactgatttcacactgaaaatcagcagggtagaggctgaagatgttggaatttattactgcatgcaaggtgcgcagtggcccccgacgttcggccaagggaccaaggtggagatcaaac

SEQ ID NO: 8084 - DNA, 325 bp, Artificial Sequence
  Synthetic construct
gaaattgtgttgacgcagtctccaggcaccctgtctttgtctccaggggaaagagccagtctctcctgcagggccagtcagagtgttggtagcgactacttagcctggtaccaacttaaacctggccaggctcccaggctcctcatctctggtgcatccaccagggccgcaggcatcccagacaggttcagtggcagcgggtctgggacagacttcactctcaccatcagcagactggaacctgaagatttcgcagtatattactgtcaccagtatggcagttcgcgtcagacgttcggccaagggaccaaggtggaaatcaaac

SEQ ID NO: 8085 - DNA, 328 bp, Artificial Sequence
  Synthetic construct
cagtctgccctgactcagcctacctccgtgtctgggtctcctggacagtcgatcaccatctcctgcactgccaccaccggtgacattggaggtcttatctcctggtatcagcaatacccaggggaagcccccgaactcattatttttgacgtcattaatcggccctctggcatctctaagcgtttctctggctccaagtctggcaacacggcctccctcaccatctctaggctccagcctgaggacgaggctgattactactgctcctcatattcgcgcagcagcgattcttatgtcttcggaagtccgaccacggtcatcgtccttg

SEQ ID NO: 8086 - DNA, 343 bp, Artificial Sequence
  Synthetic construct
tccatcgtgatgacccagtctccagagtccctagatgtgtctctgggcgagagggccaccatccactgcaagtccagccacagtgtcttatctaatttgaataataaggattacttggcttggtaccagcaaaagccgggacagccccctaagttgctcatttactgggcttctacccgggattccggggtccctgaccgattcagtggcagcggatctgggacagatttcactctcacaatcagaggcgtgcaggctgaagatgtggcagtctattactgtcagcaatattataccagtcctccgtatactttcggcccggggaccaagctgcacgtcaaac

SEQ ID NO: 8087 - DNA, 319 bp, Artificial Sequence
  Synthetic construct
gacatccagatgacccagtctccttccaccctgtctgcatctgtaggagacagagtcaccatcacttgccgggccagtcagagtattactagctggttggcctggtatcagcagaaaccagggaaagcccctaaactcctaatctatcaggcgtctaatttacaaagtggggtcccatcaaggttcagcggcagtgggtctgggacagaattcactctcaccgtcaccagcctgcagcctgatgattttgcaacttactactgccaacaatatcaaagttattcttctttcggcggagggaccaaggtggagctcaaac

SEQ ID NO: 8088 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcaataatcggccctcagggatttctaatcgcttctctggctccaagtctggcaacacggcctccctgaccatctctgggctccaggctgacgacgaggctgattattactgcacctcatatacaaacgacaccaattctcaggtattcggcggagggaccaagctgaccgtcctag

SEQ ID NO: 8089 - DNA, 334 bp, Artificial Sequence
  Synthetic construct
cagtctgccctgactcagcctgcctccgtgtctgggtctcctggacagtcgatcaccatctcctgcactggaaccaacagtgatgttgggagttataaccttgtctcctggtaccaaaaccacccaggcaaagcccccaaagtcttgatttatgagggcagtaagcggccctcaggggtttctaatcgcttctctggctccaagtctggcaacacggcctccctgaccatctctgggctccaggctgacgacgaggctgattattactgcacctcatatacaaacgacaccaattctcaggtattcggcggagggaccaagctgaccgtcctag

SEQ ID NO: 8090 - DNA, 322 bp, Artificial Sequence
  Synthetic construct
gaaatagtgttgacgcagtctccagccaccctgtctatgtctccaggggaaagagccaccctctcctgcagggccagtcagagtgtcggttcctccttcgcctggtaccagcagaagcctggccaggctcccaccctcctcatctctgctgcatccttcagggccaccggtgtttctcccaggttcagtgccagtggggctggggcggatttcactctcaccatcagcagactgcagtctgaggattctgcagtctacttttgtcatcaatattatgactggccgtggacgttcggccaagggaccaaggtggaaatcaagc

SEQ ID NO: 8091 - DNA, 325 bp, Artificial Sequence
  Synthetic construct
gaaatagtgatgacgcagtctccagtcaccctgtctgtgtctccaggggaaagagtcaccctctcctgtagggccaatcggagtatcagcaccaacttggcctggtatcagcagaaacctggccaggctcccagtctcctcatctatgatgcttctgccagggccgctggtgtcccagccaggttcagtgccagtgggtctgggacagagttcactctcaccatcagcagtctgcagtctgaagattttgcaaaatattactgtcagcactataataagtggccccctttcactttcggcccggggaccaaggtggaaatcaagc

SEQ ID NO: 8092 - DNA, 331 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgatcatctctgggctccaggctgaggacgaggctgattattactgcagctcatatacaaccagcaacactctggtattcggcggagggaccaagctgaccgtcctag

SEQ ID NO: 8093 - DNA, 325 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgttcactttcggccctgggaccaaagtggatatcaaac

SEQ ID NO: 8094 - DNA, 325 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggatcactttcggccctgggaccaaagtggatatcaaac

SEQ ID NO: 8095 - DNA, 325 bp, Artificial Sequence
  Synthetic construct
gacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagtacccctccgctcactttcggcggagggaccaaggtggagatcaaac

SEQ ID NO: 8096 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcaaaaaccagggaaagcccctaagctcctgatctatgctgcatccagtttgcaaagtggggtcccatcaaggttcagtggcagtggatctgggacagatttcactctcaccatcagcagtctgcaacctgaagattttgcgacttactactgtcaacagagttacttgaacaggtggacgttcggccaagggaccaaggtggaaatcaaac

SEQ ID NO: 8097 - DNA, 325 bp, Artificial Sequence
  Synthetic construct
tcctatgagctgacacagccaccctcggtgtcagtgtccccaggacaaccggccaggatcacctgctctggagatgcattgccaaagaaatttgcttattggtaccagcagaagtcaggccaggcccctgtgctggtcatccatgaggacaacaaacgaccctccgggatccctgagagattctctggttccagctcagggacagtggccaccttgactatcagtggggcccaggtggaggatgaaggtgactactactgttattcaacagacagcagtggtactcatagggtattcggcggagggaccacgctgaccgtcctag

SEQ ID NO: 8098 - DNA, 325 bp, Artificial Sequence
  Synthetic construct
gacatccagttgacccaatctccatcctccctgtctgcatctgtaggagacagagtcaccatcacttgccaggcgagtcaggacattaagaactatttaaactggtatcaacataaaccagggaaagccccaaaactcctgatcttcgatgcatccttattgcaagcaggggtcccatcaaggttcagtggaagtggatctgggacccattttactttcaccatcagtagcctgcagcctgaagacgttgcaacatattactgtcaacaatatgaaattctgcctcggttcactttcggccctgggaccaaagtggatctcaaac

SEQ ID NO: 8099 - DNA, 322 bp, Artificial Sequence
  Synthetic construct
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatggtgcatccagtttgcaaagtggggtcccgtcaaagttcagcggcagtggatctgggacagatttcactctcaccatcaccagcctgcagcctgaagattttgcaacttattactgccaacagtataatagttaccctttcactttcggccctgggaccaaagtggatctcaaac

SEQ ID NO: 8100 - DNA, 325 bp, Artificial Sequence
  Synthetic construct
gaaacagtgatgacgcagtctccagccaccctgtctgtgtctccaggggaaagagtcaccctctcctgcagggccagtcagagtgttagtagcaacttagcctggtaccagcagagacctggccaggctcccaggctcctcatctctggtgcatctaccagggccactggtgtcccaggcagattcagtggcggtgggtctgggacagagttcactctcaccatcagcggcctgcagcctgaagattttgcagtttattactgtcagcagtataagaactggcctccgaacacttttggccaggggaccaaggtggaatccaaac

SEQ ID NO: 8101 - DNA, 325 bp, Artificial Sequence
  Synthetic construct
gaaattgtgttgacgcagtctcctggcaccctgtctttgtctccaggacaaagagccaccctctcctgcagggccagtcagagtgtaaatggcaactacttagcctggtacaagcagatgcctggccaggctcccaggctcctcatctatggtacatccagcagggccactggcgttccagacaggttcagtggcagtgggtctgggacagacttcactctcaccatcggcagcctggagcccgcagattttgcaatatatttctgtcagcagtatggtaactcacagatcacgttcggccaagggacacgactggagattaaac

SEQ ID NO: 8102 - DNA, 322 bp, Artificial Sequence
  Synthetic construct
gaagttgtgctgactcagtctccagactttcagtctgtgactccaaaggagaaagtcaccatcacctgccgggccagtcagagcattggtattagcttacactggtaccagcagaaaccaaatcagtctccaaaggtcctcatcaaatatgcttcccagtccatcccaggggtcccctcgaggttcagtggcagtggatctgggacagatttcaccctcaccatcaatagcctggaagctgaagatgctgcaacgtattactgtcatcagagttatactttagcgaacacttttggccaggggaccaagctggagatcaaac

SEQ ID NO: 8103 - DNA, 322 bp, Artificial Sequence
  Synthetic construct
gacatccagatgacccagtctccatcttccgtgtctgcatctgtaggagacagagtcaccattacttgtcgggcgagtcagggtattagcagctggttagcctggtatcaacagaaaccagggaaagcccctaagctcctgatctatgctgcatccagtttgcaaagtggggtcccatcaaggtttagcggcagtggatctgggacagatttcactctcaccatcagcagcctgcagcctgaagattttgcaacttactattgtcaacaggctaacagtttcccaatcaccttcggccaagggacacgactggagattaaac

SEQ ID NO: 8104 - DNA, 328 bp, Artificial Sequence
  Synthetic construct
gacatccagatgacccagtctccatcctccctgtctgcatctgtgggagccagagtcaccttcacttgccgggcaagtcagaacattaacagcaatttaaattggtatcaacagagacctgggaaagcccctcagctcctgatctatgctgcatccactttgcaaagtggggtcccttcaaggttcagtggcagtggatctgggacagatttcactctcaccatcagcagtctgcaacctgaagattctgcaacctactactgtcaacagagttacagtgcccctccggtgtacagttttggccaggggaccaagctggagatcaaac

SEQ ID NO: 8105 - DNA, 325 bp, Artificial Sequence
  Synthetic construct
gaaattgtgttgacgcagtctccaggcaccctgtctttgtctccaggggaaagagccaccctctcctgcagggccagccagagtgttagcagcaactacttagcctggtaccagcagaaacctggccaggctcccaggctcctcatctatgatgcatccaccagggccactggcgtcccagacaggttcagtggcagtgggtctgggacagacttcactctcagcatcagaggagtgcagcctgaggattctgcagtgtattactgtcagcagtatggtacctcacctctgacgttcggccaagggaccaaggtggaaatcaaac

SEQ ID NO: 8106 - DNA, 340 bp, Artificial Sequence
  Synthetic construct
gacatcgtgatgacccagtctccagactccctggctgtgtctctgggcgagagggccaccatcaactgcaagtccagccagagtgttttatacaactccaacaataagaactacttagcttggtatcagcgcaaaccaggacagcctcctaagttgctcatttactgggcatctacccgggaatccggggtccctgaacgattcagtggcagcgggtctgggacagatttcactctcaccatcagcagcctgcaggctgaagatgtggcagtttattactgtcagcaatattttggtactcctctcactttcggcggagggaccaaggtggagatcaaac

SEQ ID NO: 8107 - DNA, 319 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatccgacgttcggccaagggaccaaggtggaaatcaaac

SEQ ID NO: 8108 - DNA, 331 bp, Artificial Sequence
  Synthetic construct
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttcgtcttcggaactgggaccaaggtcaccgtcctag

SEQ ID NO: 8109 - DNA, 325 bp, Artificial Sequence
  Synthetic construct
tcctatgagctgacacagccaccctcggtgtcagtgtccccaggacagacggccaggatcacctgctctggagatgtattgccaaagcaatatgcttattggtaccagcagaagccaggccaggcccctgtgctggtgatatataaagacagagagaggccctcagggatccctgagcgattctctggctccagctcagggacaacagtcacgttgaccatcagtggagtccaggcagaagacgaggctgactattactgtcaatcagcagacagcagtggtacttatgtggtattcggcggagggaccaggctgaccgtcgtag

SEQ ID NO: 8110 - DNA, 322 bp, Artificial Sequence
  Synthetic construct
gacatccagatgacccagtctccatctgccatgtctgcatctgtaggagacagagtcaccatcacttgtcgggcgagtcagggcattagcaattatttagcctggtttcagcagaaaccagggaaagtccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttatccgtggacgttcggccaagggaccaaggtggaaatcaaac

SEQ ID NO: 8111 - DNA, 334 bp, Artificial Sequence
  Synthetic construct
cagtctgccctgactcagcctgcctccgtgtctgggtctcctggacagtcgatcaccatctcctgcactggaaccagcagtgacgttggtgcttataactatgtctcctggtaccaacaaaagccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 8112 - DNA, 334 bp, Artificial Sequence
  Synthetic construct
cagtctgccctgactcagcctgcctccgtgtctgggtctcctggacagtcgatcaccatctcctgcactggaaccaacagtgatgttgggagttataaccttgtctcctggtaccaaaaccacccaggcaaagcccccaaactcttgatttatgcgggcagtaagcggccctcaggggtttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 8113 - DNA, 319 bp, Artificial Sequence
  Synthetic construct
tcctatgacctgactcagccgccctccgtgtccgtgtcccctggacagagagccaccatcacctgctctggagataatttgggggacaaatatatttcatggtatcaacagaagccaggccagtcccctctattggtcatctatcaagatactcggcggccctcagggatcccagagcgattctctggctccaattctgggaaagcggcctctctgaccatcagcgggacccaggctatggatgaggctgactattactgtcaggcgtgggacacaagcgctgcgattttcggcggagggaccaagctgaccgtccttg

SEQ ID NO: 8114 - DNA, 322 bp, Artificial Sequence
  Synthetic construct
tcttctgagctgactcaggaccctgctgtgtctgtggccctgggccagacagtcaggatcgcatgccaaggagacagcctcagaagttattttgcaaactggtaccagcagaagccaggacaggcccctaaacttatcctctatggtaataataaccggccctcagggatcccagaccgcttctctggctccaactcaggagacacagcttccttgaccatcactggggctcaggcggaagatgaggccgactattactgtaactcccgttacagcagtgcttaccaggtgttcggcggagggaccaagttgaccgtcctag

SEQ ID NO: 8115 - DNA, 322 bp, Artificial Sequence
  Synthetic construct
gacatccagataacccagtctccatcctccctgtctgcatctgtaggagacagagtcaccatcacttgtcgggcgagtcacgacattgacaactatttaaattggtatcagcagaaaccagggaaagcccctaagctcctgatctacgatgcatccaatttggaaacaggggtcccatcaaggttcagtggaagtggatctgggacagattttactttcaccatcagcgtcctgcagcctgaagatattgcaacatatttctgtcagcagtgtgataatctccctttcactttcggcggagggaccaaggtggagatcaaac

SEQ ID NO: 8116 - DNA, 322 bp, Artificial Sequence
  Synthetic construct
gacatccagatgacccagtctccatcctcactgtctgcatctgtaggagacagagtcaccatgacttgtcgggcgagtcaggccattagccataatttagcctggtttcagcagaaaccagggaaagcccctaagtccctgatctatgctgcatccagtttgcaaagtggggtcccatcaaagttcagcggcaatggatctgggtcagatttcactctcaccatcagcagcctgcagcctgaagattttgcaacttattactgccaacaatataatagtttcccgtacacttttggccaggggaccaagctggagatcaaac

SEQ ID NO: 8117 - DNA, 336 bp, Artificial Sequence
  Synthetic construct
gagattgtgatgacccagactccgctctccttgtctatcacccctggagagcaggcctccatgtcctgcaggtctagtcagagcctcctgcatagtgatggatacacctatttgtattgctttctgcagaaatgcaggccagtctccacactcctgatctatgaagtttccacccggttctctggagtgccagataggttcagtggcagcgggtcagggacagatttcacactgaaaatcagccgggtggaggctgaggatgttggaattattattgcatgcaagatgcacaggatctgtggacgttcggccaagggaccaaggtggaaatcaaac

SEQ ID NO: 8118 - DNA, 343 bp, Artificial Sequence
  Synthetic construct
gacatcgtgatgacccagtctccagactccctggctgtgtctctgggcgaaagggccaccatcaactgcaagtccagccagagtgttttatacagctccgacaataaaaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcttccgtcgacgttcggccaagggaccaaggtggaaatcaaac

SEQ ID NO: 8119 - DNA, 331 bp, Artificial Sequence
  Synthetic construct
aattttatactgactcagccccactctgtgtccgagtctccggggaagacggtcaccatctcctgcacccgcagcagtggcagcattgccagcaactatgtgcagtggtaccagcagcgcccgggcagtgtccccaacaatgtgatctatgaggataaccaaagaccctctggggtccctgatcggttctctggctccatcgacagctcctccaactctgcctccctcaccatctctggactgaagactgaggacgaggctgactactactgtcagtcttacgatagcatctcttgggtgttcggcggagggaccaagctgaccgtcctgg

SEQ ID NO: 8120 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaac

SEQ ID NO: 8121 - DNA, 337 bp, Artificial Sequence
  Synthetic construct
gatgttgtgatgactcagtctccactctccctgcccgtcacccttggacagccggcctccatctcctgcaggtctagtcaaagcctcgtacacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccccggacgttcggccaagggaccaaggtggaaatcaaac

SEQ ID NO: 8122 - DNA, 154 bp, Artificial Sequence
  Synthetic construct
cctgaccgattctctgcctccaagtctgactcgtcagccaccctggacatagccggactccagactggcgacgaggccgactactactgcggcacatgggatagcagcctgggaggtgtggtcttcggcggagggaccaagctgaccgtcctag

SEQ ID NO: 8123 - DNA, 325 bp, Artificial Sequence
  Synthetic construct
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgctcactttcggcggagggaccaaggtggagatcaaac

SEQ ID NO: 8124 - DNA, 334 bp, Artificial Sequence
  Synthetic construct
cagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcatgtcttcggaactgggaccaaggtcaccgtcctag

SEQ ID NO: 8125 - DNA, 331 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaggtcttcggaactgggaccaaggtcaccgtcctag

SEQ ID NO: 8126 - DNA, 322 bp, Artificial Sequence
  Synthetic construct
gccatccggataacccagtctccatcctcactctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttacccattcactttcggccctgggaccaaagtggatatcaaac

SEQ ID NO: 8127 - DNA, 257 bp, Artificial Sequence
  Synthetic construct
cagtctgccctgactcagcctgcctccgtgtctgggtctcctggacagtcgatcaccatctcctgcactggaaccagcagtgacgttggtggttataaggatttctaatcgcttctctggctccaagtctggcaacacggcctccctgatcatctctggcctccaggttgacgacgaggctgattattactgcacctcatatacaaacaacaccaattctcaggtattcggcggagggaccaagctgaccgtcctag

SEQ ID NO: 8128 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccccggacgttcggccaagggaccaaggtggaaatcaaac

SEQ ID NO: 8129 - DNA, 325 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcatctagtttagaaagtggggtcccatcaaggttcagcggcagtggatctgggacagaattcactctcaccatcagcagcctgcagcctgatgattttgcaacttattactgccaacagtataatagttattccctggggacttttggccaggggaccaagctggagatcaaac

SEQ ID NO: 8130 - DNA, 331 bp, Artificial Sequence
  Synthetic construct
cagtctgccctgactcagcctgcctccgtgtctgggtctcctggacagtcgatcaccatctcctgcactggaaccagcagtgatgttgggacttatgaccttgtctcctggtaccaacagcacccaggcaaagcccccaaactcatgatttatgaagtcaataagcggccctcaggggtttctaatcgcttctctggctccaagtctggcaacacggcctccctgacaatctctgggctccaggctgaggacgaggctgattattactgctgctcatatgcaggtaataatatcccgctattcggcggcgggaccaagctgaccgtcctag

SEQ ID NO: 8131 - DNA, 340 bp, Artificial Sequence
  Synthetic construct
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgctcactttcggcggagggaccaaggtggagatcaaac

SEQ ID NO: 8132 - DNA, 331 bp, Artificial Sequence
  Synthetic construct
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggagtcttcggaactgggaccaaggtcaccgtcctag

SEQ ID NO: 8133 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtacttcgtacacttttggccaggggaccaagctggagatcaaac

SEQ ID NO: 8134 - DNA, 331 bp, Artificial Sequence
  Synthetic construct
cagtctgccctgactcagcctgcctccgtgtctgggtctcctggacagtcgatcaccatatcctgcactggaaccagcagtgacgttggtggttataattctgtctcctggtaccaacaacacccaggcaatgcccccaaagtcatgatttatgatgtcattaaccgaccctcaggggtttctagtcgcttctctggctccaagtctggcaacacggcctccctgaccatctctgggctccaggctgaggacgaggctacttattactgcagctcatatacaatccgcagcacccatgtcttcggagctgggaccaaggtcaccgtcctag

SEQ ID NO: 8135 - DNA, 325 bp, Artificial Sequence
  Synthetic construct
gaaattgtgttgacgcagtctccaggcaccctgtctttgtctccaggggaaagagccaccctctcctgcagggccagtcagagtgttcccagcagctatttagcctggtaccagcagaaacctggccaggctcccaggctcctcatctatggtgcatccagcagggccactggcatcccagacaggttcagtggcagtgggtctgggacagacttcactctcaccatcagcagaccggagcctgaagattttgcagtgtattactgtcagcaatatggtagccctccgtggacgttcggccaagggaccaaggtggaaatcaaac

SEQ ID NO: 8136 - DNA, 196 bp, Artificial Sequence
  Synthetic construct
gtccgtgggctttatgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaagttgaccgtcctag

SEQ ID NO: 8137 - DNA, 322 bp, Artificial Sequence
  Synthetic construct
gacatccagatgacccagtctccttccaccctgtctgcatctgtaggagacagagtcaccatcacttgccgggccagtcagagaattagtagctgggtggcctggtatcagcagaaaccagggaaagcccctaagctcctgatctataaggcagttagtttagaaggtggtgtcccatcaaggttcagcggcagtggatctgggacagaattcactctcaccatcagccgcctgcagcctgatgatttttcaacttattactgccaacagtatgatagttatccggaaacgttcggccaagggaccaaggtggaaatcaaac

SEQ ID NO: 8138 - DNA, 334 bp, Artificial Sequence
  Synthetic construct
cagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcccttgggtgttcggcggagggaccaagctgaccgtcctag

SEQ ID NO: 8139 - DNA, 322 bp, Artificial Sequence
  Synthetic construct
gaaattgtgttgacacagtctccagccaccctgtctttgtctccaggggaaagagccaccctctcctgcagggccagtcagagtgttagcagctacttagcctggtaccaacaaaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaac

SEQ ID NO: 8140 - DNA, 322 bp, Artificial Sequence; identical to SEQ ID NO: 1831
  Synthetic construct

SEQ ID NO: 8141 - DNA, 325 bp, Artificial Sequence
  Synthetic construct
gaaattgtattgacgcagtctccaggcaccctgtctttgtctccaggggaaagagccaccctctcctgcagggccagtcagagtgttagcagcaactccttagcctggtaccagcagatacctggccaggctcccaggctcctcatctatggtgcatccggcagggccactggcatcccagacaggttcagtggcagtgggtctgggacagacttcactctcaccatcagcagactggagcctgaagattttgcagtgtattactgtcagcagtatcataactcactggacacttttggccaggggaccaagctggagatcaaac

SEQ ID NO: 8142 - DNA, 340 bp, Artificial Sequence
  Synthetic construct
gacatcgtgatgacccagtctccagactccctggctgtgtctctgggcgagagggccaccatcaactgcaagtccagccagagtgttttatacacttccaacaataagaactacttagcttggtaccagcagaaaccacgacagcctcctcagctgctcatttactgggcatctacccgggaatccggggtccctgaccgattcagtggcagcgggtctgggacagatttctctctcaccatcagcagcctgcaggctgaagatgtggcagtttattactgtcagcaatattatactactccgtggacgttcggccaagggaccaaggtggaagtcaaac

SEQ ID NO: 8143 - DNA, 331 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccggcattcactttcggccctgggaccaaagtggatatcaaac

SEQ ID NO: 8144 - DNA, 325 bp, Artificial Sequence
  Synthetic construct
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgatcaccttcggccaagggacacgactggagattaaac

SEQ ID NO: 8145 - DNA, 331 bp, Artificial Sequence
  Synthetic construct
cagactgtggtgacccaggagccatcgctctcagtgtcccctggagggacagtcacactcacttgtggcttgaggtctggctcagtctctactagtgactaccccagttggtaccagcagaccccaggccagcccccacgctcgctcatctacagcacagacactcgctcttctggggtccctgatcgcttttctggctccatccttgggaacaaagctgccctcaccatcacgggggcccaggcagatgatgaatctgattattactgtgtgctctttgtgggtggtggcatttggctattcggcggagggaccaggctgaccgtcctag

SEQ ID NO: 8146 - DNA, 337 bp, Artificial Sequence
  Synthetic construct
gatattgtgatgactcagtctccactctccctgcccgtcaccctaggccagtcggcctccatctcctgcaggtctagtcaaagcctcgtgtccagtaatgggaacacctacttcacttggtttcaacagaggccaggccaatctccaaggcgcctaatttatgaggtttctaagcgggactctggggtcccagacagattcagcggcagtgggtcaggcactgatttctcactgaagatcagcagggtggaggctgaggatattgggtcttattactgcatgcagggtgcacactggccgtacacttttggccaggggaccaagctggagatcaagc

SEQ ID NO: 8147 - DNA, 331 bp, Artificial Sequence
  Synthetic construct
cagactgtggtgacccaggagccatcgttctcagtgtcccctggagggacagtcacactcacttgtggcttaagctctggctcagtctctactagttacttccccatctggtaccagcagaccccaggccaggctccacgcacgctcatctacaacacaagcactcgctcttctggggtccctgatcgcttctctggctccatccttgggaacaaagctgccctcaccatcacgggggcccaggcagatgatgaatctgattattactgtgtgctttatatgactagtggcattgtgctattcggcggagggaccaagctgaccgtcctag

SEQ ID NO: 8148 - DNA, 319 bp, Artificial Sequence
  Synthetic construct
tcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctggtattcggcggagggaccaagctgaccgtcctag

SEQ ID NO: 8149 - DNA, 337 bp, Artificial Sequence
  Synthetic construct
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctttcactttcggccctgggaccaaagtggatatcaaac

SEQ ID NO: 8150 - DNA, 337 bp, Artificial Sequence
  Synthetic construct
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttgggcttttggccaggggaccaagctggagatcaaac

SEQ ID NO: 8151 - DNA, 322 bp, Artificial Sequence
  Synthetic construct
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgatgatctccctctcactttcggcggagggaccaaggtggagatcaaac

SEQ ID NO: 8152 - DNA, 322 bp, Artificial Sequence
  Synthetic construct
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatatccctctgacgttcggccaagggaccaaggtggaaatcaaac

SEQ ID NO: 8153 - DNA, 322 bp, Artificial Sequence
  Synthetic construct
gacatccagatgacccagtctccatcctccctgtctgcatctataggggacagagtcaccatcacttgccggacaagtcagagcattagtacctatttagattggtatcagcagaaaccagggaaagcccctaaactcctgatttatgctacatccactttgcaaagtggggtcccatcaaggttcagtggcagtggatctgggacagatttcactctcactatcagcagtctgcaacctgaagactttgcaacttactactgtcgacagacttacagtaccccgtacacttttggccaggggaccaagctggagatcaaac

SEQ ID NO: 8154 - DNA, 322 bp, Artificial Sequence
  Synthetic construct
gaaattgtgttgacacagtctccagccaccctgtctttgtctccaggggaaagagccaccctctcctgcagggccagtcagagtgttagcagctacttagtctggtaccaacagaaacctggccaggctcccaggctcctcacctatgatgcatccaacagggccactggcatcccagccaggttcagtggcagtgggtctgggacagacttcactctcagcatcagcagcctagagcctgaagattttgcagtttattactgtcagcagcgtatcaactggccgctcaccttcggcggagggaccaaggtggagatcaaac

SEQ ID NO: 8155 - DNA, 322 bp, Artificial Sequence
  Synthetic construct
gacatccagatgacccagtctccatcctccctgtctgcatctgtaggagacagagtcaccatcacttgccgggcaagtcagagcgttaacaactatttaaattggtatcagcagaaaccagggaaagcccctaaactcctgatctatgctgcatccagtttgcaaagtggggccccatcaaggttcagtggcagtggatctgggacagatttcactctcaccatcagcagtctgcaacctgaagattttacaacttactactgtcaacagagttacagtacccctccaagtttcggcggagggaccaaggtggagatcaaac

SEQ ID NO: 8156 - DNA, 337 bp, Artificial Sequence
  Synthetic construct
gatgttgtgatgactcagtctccactctccctgcccgtcagccttggacagccggcctccatctcctgcaggcccggtcaaagcctcgttcacactgatggctacacctacttaaattggtttcaccagaggccaggccaatctccaaggcgcctcatttatagggtttctaaccgtgacgctggtgtcccagacagattcagcggcagtgagtcaggcactgatttcatactaaaaatcagtagtgtggaggctgaggatcttggcatttattactgcatgcagggcacacactggccttggacgttcggccaagggaccagggtggaaatcaaac

SEQ ID NO: 8157 - DNA, 325 bp, Artificial Sequence
  Synthetic construct
ccctatgttctgactcagccaccctcggtgtcggtggccccaggacagacggccaggattacctgtgggggaaacgacattgaaactagaagtgtgcactggtaccagaagaagtcaggccaggcccctgtgctcgtcgtctatgatgacagcgaccggccctcagggatccctgagcgattctctggctccaactctgggaacacggccaccctgacaatcaccagggtcgaagccggagatgaggccgaatatttctgtcaggtctgggattttaatagtgatcatgcactgttcggcggagggaccaggatgaccgtcctag

SEQ ID NO: 8158 - DNA, 334 bp, Artificial Sequence
  Synthetic construct
aaatttttgctgacccagccgcactctgtgtcggagtctccggggaagacattaaccatctcctgcacccgcagcagtggcagcattgccagcaactatgtgcagtggtaccaacagcgcccgggcagcgcccccgtctctgtgatctatgaggatacacaaagaccctctggggtcccggctcggttctctggctccatcgacagctcctccaattctgcctccctcaccatctctggactgcagactgaggacgagggtgactactattgtcagtcttatgataacaattttgattgggttttcggcggagggaccaaagtgaccgtcctaa

SEQ ID NO: 8159 - DNA, 313 bp, Artificial Sequence
  Synthetic construct
gacatccagatgacccagtctccttcaaccctgtctgcatcgataggagacagagtcagcctcacttgccgggccagtcagactattaatacttggctggcctggtatcagcagaagccagggaaagcccctaagctcctgatctataaggcctctactttggaaagtggggtcccatcaaggttcagtggcgctggatctgggacagaattcactctcaccatcagcaacctgcagccggatgactttgcgatttattactgccaataccccccgaggacgttcggccaagggaccaaggttgaagtcaaac

SEQ ID NO: 8160 - DNA, 325 bp, Artificial Sequence
  Synthetic construct
gaaatagtgatgacgcagtctccaggcaccctgtctgtgtctccaggggacagagtcatcctctcctgcagggccagtgagagtgttagcaaccacttggcctggtaccagcacaaacgtggccaggctccccggctcctcatctatggtgggtcaatcagggccactggcgtcccagccaggttcagtggcagtgggtctgggacagacttcactctcaccatcagtggcctgcagtctgaagattttgcaacgtattattgtcagcactataacattgggcacggccacacttttggtcaggggactgaactggatctcaaac

SEQ ID NO: 8161 - DNA, 340 bp, Artificial Sequence
  Synthetic construct
gacatcgtgatgacccagactccagactccctggctgtgtctctgggcgagagggccaccatcaactgcaagtccagccagaatgttttatacagctccaacaataagaactacttagcttggtaccagcataaaccaggacagtctcctaaactgctcatttactgggcatctacccgggaatccggagtccctgaccgaatcagtggcagcgggtctgggacagatttcactctcaccatcagcagcctgcaggctgaagatgtggcagtttattactgtcagcaatattatagtgccccgtggacgttcggccaagggaccaaggtggaaatcaaac

SEQ ID NO: 8162 - DNA, 328 bp, Artificial Sequence
  Synthetic construct
tcctatgtgctgactcagccaccctcggtgtcagtggccccaggtcagacggccagaattacctgtgagggaaccaacattggaaggaaaagtgtgcactggtaccagcagaagtcaggccaggcccctgtgttggtcgtctatggtgatagcgagcggccctcagggatccctgagcgattctccggctccaaatcaaggaacacggccaccctgatcatcaactgggtcgaggccggggatgaggccgactattcctgtcaggtgtgggacattagtgatgagcatccttatgtcttcggacctgggaccaaggtcaccgtcctac

SEQ ID NO: 8163 - DNA, 322 bp, Artificial Sequence
  Synthetic construct
gacatccagatgacccagtctccatcctccctgtctgcatctgtaggagacagagtcaccatcacttgccgggcaagtcaaagcattagcggctatttaaattggtatcagcagaaacctgggaaagcccctaacctcctgatctatgctgcatccagtcttctaagtgaggtcccatcgaggttcagtggcagtggatctgggacagatttcgctctcaccatcagcagtctgcaacctgaagactttgcaacttactactgtcaacagggttacagtaccccgttcaccttcggccaagggacacgactggagattaagc

SEQ ID NO: 8164 - DNA, 331 bp, Artificial Sequence
  Synthetic construct
aattttatgctgactcagccccactctgtgtcggagtctccggggaagacggtaaccatctcctgcacccgcagcagtggcagcattgccagcagctatgtgcagtggtaccagcaacgcccgggcagtgcccccacaactgtgctctatgagactaaccaaagaccctctggggtccctgatcggttctctggctccatcgacagctcctccaactctgcctcccttcacatctctggactgaagactgaggacgaggctgactactactgtcagtcttattatggcggcaatcaggtgttcggcggaggtaccaaggtgaccgtcctaa

SEQ ID NO: 8165 - DNA, 334 bp, Artificial Sequence
  Synthetic construct
cagcctgtgctgactcagccatcttcccattctgcatcttctggagcatcagtcagactcacctgcatggtgagcagtggcttcagtgttggggacttctggataaggtggtaccaacaaaagccagggaaccctccccggtatctcctgtactaccactcagactctggagttcccagccgcttctctggatccaacgatgcatcagccaatgcagggattctgcgtatccctgggctccagcctgaggatgaggctgactattactgtggtacatggcacagcaactctaagactcgagtgttcggcagtggcaccaaggtgaccgtcctcg

SEQ ID NO: 8166 - DNA, 331 bp, Artificial Sequence
  Synthetic construct
cagtctgtgctgactcagccaccctcagcgtctgggacccccgggcagagggtcaccatctcttgttctggaagcaagtccaacatcggaagtaatactgtaaactggtaccagcaactcccaggaacggcccccaaattcctcatctataggaatgatcagcggccctcaggggtccctgaccgattctctggctccaagtctggcacctcagcctccctggccatcagtgggctccaggccgaggatgaggctgattattcctgtgcagcttgggatgacagcctgaatggtgtagtcttcggcggagggaccaagctgaccgtcctag

SEQ ID NO: 8167 - DNA, 325 bp, Artificial Sequence
  Synthetic construct
gccatccggatgacccagtctccatcctcactctctgcatctacaggagacagagtcaccatcacttgtcgggcgagtcagggtattggcagttatttagcctggtatcagcaaaaaccaggaaaagcccctaaactcctcatccatgcttcatccactttacaaagtggggtcccatcaaggttcagtggcagtggatctgggacaactttcactctctccatcagctgcctgcagtctgaagattttgcaacttattactgtcaacagtattataatttcctccctctcactttcggcggagggaccaaggtggagatcagac

SEQ ID NO: 8168 - DNA, 325 bp, Artificial Sequence
  Synthetic construct
gaaattgtgttgacgcagtctccaggcaccctgtctttgtctccaggggaaagagccaccctctcctgcagggccagtcagagtgttcgcagtagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtacctcactgttcacttttggccaggggaccaagctggagatcaaac

SEQ ID NO: 8169 - DNA, 334 bp, Artificial Sequence
  Synthetic construct
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataggcgaccctcagggattcctgaccgattctctggctccaagtctggcacgtcagccaccctgggcatcaccggactccagactggggacgaggccgattatttctgcggaacatgggatagcagcctgagtgcaccttgggtgttcggcggagggaccaagctgaccgtcctac

SEQ ID NO: 8170 - DNA, 322 bp, Artificial Sequence
  Synthetic construct
gacatccagctgacccagtctccatcttccgtgtctgcctctgtgggagacagagtcaccatgacttgtcggacgagtcgtggtattaacgatttgttagcctggtatcagcataaaccggggacagcccctaaactcctgatctatgctgcctccattttacatagtggggtcccgtcaaggttcagcggcagtgggtctgggacagatttcactctcaccatcagcagcctgcagcctgaagattttgcaacttactattgtctgcaggctaacactatgcctctcactttcggcggcgggaccaaggtggagatcaagc

SEQ ID NO: 8171 - DNA, 337 bp, Artificial Sequence
  Synthetic construct
gacatcgtgatgacccagtctccagactccctggctgtgtctctgggcgagagggccaccatcaagtgcaagtccagccagagtgtctcatataacagtaagaattacttagcttggtatcagcagaaaccaggacagcctcctaagctgctcattttctgggcctctacccgggaatccggggtccctgaccgattcagtggcagcgggtctgggacagacttcactctcaccatcagcagtctgcaggctgaagatgtggcagtttatttctgtcaacaatattatactacttctgctctcactttcggcggagggaccaaggtggaggtcaaac

SEQ ID NO: 8172 - DNA, 334 bp, Artificial Sequence
  Synthetic construct
agtttcatgctgactcagtctcactctgtgtcggactctccggggaagacagttaccatctcctgcacccgcaccagtggcagcattgccaacaactatgtgcagtggtaccagcagcgcccgggcagcgcccccaccattttgatctatgaagatacccaaagaccctctggggtacctgatcgcttctttggctccatcgacaagtcctccaactctgcctccctcaccatatctgggctcgagactgacgacgaggctgactacttctgtcagtcttttgatagcacttctcactgggtgttcggcggtgggaccaagctgaccgtcctac

SEQ ID NO: 8173 - DNA, 325 bp, Artificial Sequence
  Synthetic construct
tcctatgtgctgactcaggcagcctcggtgtcagtcgccctaggacagacggccacaattccctgtgggggagacaacattggaactaagagtgtgcattggtatttgcagaagccaggccgggcccctgttttggtcgtctttgatagttatttccggccctccgggatccctgagcgagtctctggctccaactctagggacacggccaccctgaccctcaacagagtcgaggccggggatgaggccgactattattgtcaagtttacgataggaatactgatcaatgggtattcggcgaagggaccaagctgaccgtcctag

SEQ ID NO: 8174 - DNA, 331 bp, Artificial Sequence
  Synthetic construct
cagtctgccctgactcagcctcgctcagtgtccgggtctcctggacagtcagtcaccatctcctgcactggaaccagcagtgatgttggtgcttatgactctgtctcctggtatcaacatcacccaggcagagcccccaaactcatgatttatgatgtcaataagcggccctcaggggtccctgatcgcttctctggctccaagtctggctacacggcctccctgaccatctctgggctccgggctgacgatgaggctgattattactgctgctcatatgcaggcagctacacttatgtcttcggaactcagaccaaggtcaccgtcctga

SEQ ID NO: 8175 - DNA, 325 bp, Artificial Sequence
  Synthetic construct
tcttctgagctgactcaggaccctgctgtgtctgtggccttgggacagacagtcacgatcacatgtcaaggagacagcctcagaagctattatgcaagctggtaccagcagaggccaggacaggcccctgttcttgtcatctatgctaaaaacaaccggccctcagggatcccagaccgattctctggctccagctcaggaaacacagcttccttgaccatcactggggctcaggcggaagatgaggctgactattactgtaactcccgggacagcagtggtaaccatcaggtcttcgcaactgggaccaaggtcaccgtcctag

SEQ ID NO: 8176 - DNA, 322 bp, Artificial Sequence
  Synthetic construct
gacatccagatgacccagtctccttccaccctgtctgcatctgtaggagacagagtcaccatcatttgccgggccagtcagagtattagtagttggttggcctggtatcagcagaaaccagggaaagcccctaaactcctgatctatcaggcatcttatttagaaggtggggtcccatcaaggttcagcggcagtggatctgggacagaattctctctcaccatcagcagactgcagcctgatgatcttgcaacttattactgccaacagtatcatacttcttcggaaaccttcggccccgggaccaaggtggaaatcaaac

SEQ ID NO: 8177 - DNA, 322 bp, Artificial Sequence
  Synthetic construct
gacatccagatgacccagtctccttccaccctgtctgcatctgtaggagacagagtcaccatcatttgccgggccagtcagagtattagtagttggttggcctggtatcagcagaaaccagggaaagcccctaaactcctgatctatcaggcatctaatttagaaggtggggtcccatcaaggttcagcggcagtggatctgggacagaattctctctcaccatcagcagactgcagcctgatgatcttgcaacttattactgccaacagtatcatacttcttcggaaaccttcggccccgggaccaaggtggaaatcaaac

SEQ ID NO: 8178 - DNA, 325 bp, Artificial Sequence
  Synthetic construct
gacatccagatgacccagtctccatccaccctgtctgcttctataggagacagagtcatcatcacttgtcgggccagtcagagtattgatagttggttggcctggtatcagcagaagcccgggaaagcccctaaactcctgatctataagacatctaatttacaaagtggggtcccaccaaggttcagcggcagtggatttgggacagaattcactctcgccatcagcagcctgcagcctgatgattttgcaacttatttctgccaacaatactatactttttcttcgtggacgttcggccaagggaccaaggtggaaatcacac

SEQ ID NO: 8179 - DNA, 319 bp, Artificial Sequence
  Synthetic construct
ggcatccagatgacccagtctccttccaccctgtctgcatctgtaggagacagagtcaccattacctgccgggccagtcagagtattaataactggttggcctggtatcagcagaaaccagggaaagcccctaagctcctgatctctaaggcgtccagtttacagagtggagtcccatcaaggttcagcggcagtggatctgagacagaattcactctcaccatcagcagcctgcagcctgatgattttggaacttattactgccaacagtatgataatttgtggtcgttcggccaagggaccaaggtggagatcaaac

SEQ ID NO: 8180 - DNA, 340 bp, Artificial Sequence
  Synthetic construct
gatgttgtgatgactcagtctccactctccctgcccgtcacccttggacagccggcctccatctcctgcatgtctaatcaaagtctcgtgtacagcgatggaaacacctacttgagttggtttcatcagaggccaggccaatctccgaggcgcctaatttataaggtttctaagcgggactctggggtcccagacagattcagcggcagtgggtccggcactaatttcacactgaagatcagcagggtggaggctgaggatgttggggattattactgcatgcaaggaacacactggcctccgtggacgttcggtcaggggaccaaggtggaagtcaaac

SEQ ID NO: 8181 - DNA, 93 bp, Artificial Sequence
  Synthetic construct
aggctgacgacgaggctgattattactgcacctcatatacaaacaacagcaattctcaggtattcggcggagggaccaagctgaccgtcctag

SEQ ID NO: 8182 - DNA, 325 bp, Artificial Sequence
  Synthetic construct
gacatccagatgacccagtctccttccaccctgtctgcatctgtaggagacagagtcaccatcacttgccgggccagtcagagtattagtaactggttggcctggtatcagcagaaaccagggaaagtccctaagctcctgatctatatggcgtctagtatagaaagtggggtcccatcaaggttcagcggcagtggatctgggacagaattcactctcaccatcaccagcctgcaccctgatgattttgcaacttattactgccaacagtataatacttattcggggtggacgttcggccaagggaccaaggtggaaatcaaac

SEQ ID NO: 8183 - DNA, 322 bp, Artificial Sequence
  Synthetic construct
gacatccagatgacccagtctccatcctccctgtctgcatctgtaggagacacagtcaccatcacttgccgggcaagtcaggacattggggatgatttaggctggtttcagcacaaaccaggcaaagcccctcagcgcctcatctatgaagcctccactttgcaaaggggggtcccatcaagatttagcgccagtgcatctggggaggacttcactctcacaatcaacagcctgcagcctgaagattttgcaacttattactgtctacagtacaaaaattaccctcgcacgttcggccaagggaccaaggtggatctcaatc

SEQ ID NO: 8184 - DNA, 322 bp, Artificial Sequence
  Synthetic construct
tcttatgagctgacacagccaccctcggtgtcagtgtccccaggacagacggccaagatcacctgctctgcagatgtgttgtcaaagcaatatgcttattggtaccagcagaagccaggccaggcccctgtgttggtgatatataaagacaatgagaggccctcacggattcctgaacgattctctggctccagctcagggacaacagccacgttgaccatcattacagtccaggcagaagacgaggctgactattactgtcaatcagcggacagcagtggtacttgggtctttggcggagggaccaagctgaccgtcctag

SEQ ID NO: 8185 - DNA, 334 bp, Artificial Sequence
  Synthetic construct
cagtctgtgctgacgcagccgccctcagtgtctggggccccagggcagagggtcaccctttcctgcactgggagcagttccaatctcgggccaggttatgatgtcaactggtaccagcagcttccaggaacagtccccaaactcctcatttatggtaaccgccatcggccctcaggggtctctgaccgattctctggctccaagtctggcacttcagcctccctggccatcactgggctccagcctcaggatgacggttattattattgtcagtcgcatgacagcagcctgactaatttcatctttggcggagggaccaagctgaccgtcctag

SEQ ID NO: 8186 - DNA, 319 bp, Artificial Sequence
  Synthetic construct
gaaattgtgttgacacagtctccagccaccctgtctttgtctccaggggaaagagccaccctctcctgcagggccagtcagagtgttagctactacttagcctggtaccaacagaaacctggccagggtcccaggctcctcatctatgatgcatccaacagggccactggcatcccagccaggttcagtggcagtgggtctgggacagacttcactctcaccatcagcagcctagagcctgaagattgtgcagtttattactgtcagcagcgtaccgactggtacacttttggccaggggaccaagctggagatcaaac

SEQ ID NO: 8187 - DNA, 322 bp, Artificial Sequence
  Synthetic construct
gacatccagctgacccagtctccatcctccctgtctgcatctgtcggagacagagtcaacatcacttgccggacaagtcagatcattaacagctatttaaattggtatcaggtgacaccaggtaaagcccctaagctcctgatctacactgcatccaatttgcaaagtgcgctcccatcaaggttcagtggcagtggatctgggacagatttcactctcaccatcagcagtctgcaacctgaggattttgcagcctacttttgtcaacagacttacagtatcccattcactttcggccctgggaccacagtcaatatcaaac

SEQ ID NO: 8188 - DNA, 133 bp, Artificial Sequence
  Synthetic construct
aagtctggcaacccggcctccctgaccatctctgggctccaggctgacgacgaggctgattattactgcacctcatatacaaacaacagcaattctcaggtattcggcggagggaccaagctgaccgtcctag

SEQ ID NO: 8189 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttctgatgtcagtaatcggccctcagggatttctaatcgcttctctggctccaagtctggcaacacggcctccctgaccatctctgggctccaggctgacgacgaggctgattattacttcacctcatatacaaacgacagcaattctcaggtattcggcggagggaccaagctgaccgtcctag

SEQ ID NO: 8190 - DNA, 325 bp, Artificial Sequence
  Synthetic construct
gaaattgtgttgacacagtccccaggcaccctgtctttgtctccaggggaaagagccaccctctcctgcagggccagtcacagtgttagcagctacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtgtcaactggccgtatctcactttcggcggagggaccaaggtggagatcaaac

SEQ ID NO: 8191 - DNA, 331 bp, Artificial Sequence
  Synthetic construct
cagtctgccctgactcagcctgcctccgtgtctgggtctcctggacagtcgatcaccatctcctgcactggaaccagcagtgacgttggtggttataactttgtctcctggtaccaacagcacccaggcaaagcccccaaactcttcatttatgaggtcactaatcggccctcaggggtttctaatcgcttctctggctccaagtctggcaacacggcctccctgaccatctctgggctccaggctgaggacgaggctgattattactgcagctcatatacaagcagcagcacttttgtcttcggaactgggaccaaggtcaccgtcctag

SEQ ID NO: 8192 - DNA, 322 bp, Artificial Sequence
  Synthetic construct
gacatccagatgacccagtctccgtcctcactgtctgcatctgttggagacagagtcaccatcacttgtcggtcgagtcagggcattagaagttatttagcctggtttcagcagaaaccaggggaagcccctaagtccctgctctatgctgcatccactttgcaaagtggggtcccatcaaggttcagcggcagtggatttgagacagatttcactctcaccataaccagcctgcagcctgaagattttgcaacttattactgccaacaatatgaaagttacccgtacacttttggccaggggaccaggctggagatcaaac

SEQ ID NO: 8193 - DNA, 337 bp, Artificial Sequence
  Synthetic construct
gatattgtgatgacccagactccactctcctcacctgtcacccttggacagccggcctccatctcctgcaggtctagtcaaagcctcgtacacagtgatggaaacacctacttgagttggcttcaggagaggccaggccagcctccaagactcctaatttataagatttctaaccggttctctggggtcccagacagattcagtggcagtggggctgggacagatttcacactgaaaatcagcagggtggaagctgaggatgtcggggtttattactgcatgcaagcttcacaatttcctctcactttcggccctgggaccgtagtggatatcaaac

SEQ ID NO: 8194 - DNA, 325 bp, Artificial Sequence
  Synthetic construct
gaaatagtgatgacgcagtctccagccaccctgtctgtgtctccaggggaaagcgccaccctctcctgcagggccagtcagagtattagcaacatcttagcctggtaccagcataaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgataagtggcctccgtggacgttcggccaagggaccaaggtggaaatcaaac

SEQ ID NO: 8195 - DNA, 331 bp, Artificial Sequence
  Synthetic construct
cagtctgccctgactcagcctgcctccgtgtctgggtctcctggacagtcgatcaccatctcctgcactggaaccagtagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgagggtgattattactgcagctcatatacaagcatcagcactgtggtattcggcggagggaccaagctgaccgtcctag

SEQ ID NO: 8196 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagtccccaaactcatgatttctgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaagctgaccgtcctag

SEQ ID NO: 8197 - DNA, 325 bp, Artificial Sequence
  Synthetic construct
gaaatagtgatgacgcagtctccagccatcctgtctgtgtctccaggggaaagagccaccctctcctgcagggccagtcagagtgttagcagcaacttagcctggtaccagcagaaacctggccaggctcccaggctcctcatctatggtgcatccgccagggccactggtgtcccagccaggttcagtggcagtgggtctgacacagagttcactctcaccatcagcagcctgcagtctgaagattttgcagtttattactgtcaacagtataattattggcctccgtacacttttggccaggggaccaagctggacatcaaac

SEQ ID NO: 8198 - DNA, 337 bp, Artificial Sequence
  Synthetic construct
gatattgtgatgactcagtctccactctccctgcccgtcacccctggagagccggcctccatctcctgcaggtctagtcagagcctcctgcatagtaatggatacaactatttggattggtacatgcagaggccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgtacacttttggccaggggaccaagctggagatcaaac

SEQ ID NO: 8199 - DNA, 322 bp, Artificial Sequence
  Synthetic construct
gaaattgtgttgacacagtctccagccaccctgtctttgtctccaggggaaagagccaccctctcctgcagggccagtcagagtgttagcagctacttcgcctggtaccaacagaaacctggccagcctcccaggctcctcatgtctgatgaatccaagagggccactggcgtcccagccaggttcagtggcagtgggtctgggacagacttcactctcaccatcagcagcctagaggctgaagattttgcggtttattattgtcagcagcgtagcagctggcctctcactttcggcggagggaccaaggtggagatcaaac

SEQ ID NO: 8200 - DNA, 331 bp, Artificial Sequence
  Synthetic construct
cagtctgccctgactcagcctgcctccgtgtctgggtctcctggacagtcgatcaccatctcctgcactggaaccagcagtgacgttggtgattatgactttgtctcctggtaccaacaacacccaggcaaagcccccaaactcatgatttatgatgtcaataatcggccctcaggggtttctaatcgcttctctggctccaagtctggcaacacggcctccctgaccatctctgggctccaggctgaggacgaggctgattattactgcaactcatatacaaacagcagcactctggtgttcggcggagggaccaagctgaccgtcctag

SEQ ID NO: 8201 - DNA, 331 bp, Artificial Sequence
  Synthetic construct
cagtctgtgttgacgcagccgccctcagtgtctgcggccccaggacagaaggtcaccatctcctgctctggaagcagctccaacattggtaataattatgtatcctggtaccagcagctcccaggaacagcccccaaactcctcatttatgacaataatgagcgaccctcagggattcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctag

SEQ ID NO: 8202 - DNA, 325 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggagcaccttcggccaagggacacgactggagattaaac

SEQ ID NO: 8203 - DNA, 319 bp, Artificial Sequence
  Synthetic construct
gaaactgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcttttcggcggagggaccaaggtggagatcaaac

SEQ ID NO: 8204 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcttgatttatgcgggcagtaagcggccctcaggggtttctaatcgcttctctggctccaagtctggcaacacggcctccctgacaatctctgggctccaggctgacgacgaggctgattattactgcacctcatatacaaacaacagcaattctcaggtattcggcggagggaccaagctgaccgtcctag

SEQ ID NO: 8205 - DNA, 325 bp, Artificial Sequence
  Synthetic construct
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgccccttatgtcttcggaactgggaccaaggtcaccgtcctag

SEQ ID NO: 8206 - DNA, 322 bp, Artificial Sequence
  Synthetic construct
tcttatgagctgacacagccaccctcggtgtcagtgtccccaggacagacggccaagatcacctgctctgcagatgtgttgtcaaagcaatatgcttattggtaccagcagaagccaggccaggcccctgtgttggtgatatataaagacaatgagaggccctcacggattcctgaacgattctctggctccagctcagggacaacagccacgttgaccatcattacagtccaggcagaagacgaggctgactattactgtcaatcagcggacagcagtggtacttgggtctttggcggagggaccaagcggaccgtccgag

SEQ ID NO: 8207 - DNA, 331 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcaggatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttgggtgttcggcggagggaccaagctgaccgtcctag

SEQ ID NO: 8208 - DNA, 322 bp, Artificial Sequence
  Synthetic construct
gacatccagatgacccagtctccatcttccgtgtctgcatctgtaggagacagagtcaccatcacttgtcgggcgagtcagggtattagcagttggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcaacctgaagattttgcaacttactattgtcaacagggtaccagtttccccttcactttcggccctgggaccaaagtggatatcaaac

SEQ ID NO: 8209 - DNA, 325 bp, Artificial Sequence
  Synthetic construct
tcctatgtgctgactcagccaccctcggtgtcagtggccccaggacagacggccagcattacctgtgggggaaacaatgttggaagaaaaagtgtgcactggtaccagcagaagccaggccaggcccctatcctggtcgtctatgatgatagcgaccggccctccgggatccctgagcgattctctggctccaactctgggaacacggccaccctgaccatcagcagggtcgaagccggggatgaggccgactattactgtcagttgtgggatagtcgtagtgatcatgtggtattcggcggagggaccaagttgaccgtcctag

SEQ ID NO: 8210 - DNA, 313 bp, Artificial Sequence
  Synthetic construct
gaaattgtattgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattctgcagtttattactgtcagcagcgtgacttcactttcggccctgggaccaaagtggaaatcaaac

SEQ ID NO: 8211 - DNA, 322 bp, Artificial Sequence
  Synthetic construct
gccatccagttgacccagtctccatccttcctgtctgcatccgctggagacagagtcaccatcacttgccgggccagtcagggcattaactcttatttagcctggtatcaacaaaagccagggaaagcccctaagctcctgatatatggtgcatccactttgcaatatggggtcccatcaaggttcagcggcagtggatctgggacagacttcactctcacaatcagcagcctgcagcctgaagattttgcaacttattactgtcaacaggttaatgcttaccccttcagtttcggccctgggaccacagttgatatcaaac

SEQ ID NO: 8212 - DNA, 322 bp, Artificial Sequence
  Synthetic construct
gaaatagtgatgacgcagtctccagtcagcctgtctgtgtctccaggggaaagagccaccctctcctgcagggccagtcagagtgttaggggcagcttagcctggtaccagcacaaacctggccaggttcccaggctcatcttctttggtgaatccatcagggccgctggtgtcccaaccaggttcagtgccagtgggtctgagacggacttcactctcaccatcagcagtgtgcaatctgaagattttgcagattattactgtcaccagtatgataactggcctctcactttcggcggcgggaccaaggtggagatcaaac

SEQ ID NO: 8213 - DNA, 334 bp, Artificial Sequence
  Synthetic construct
aattttatgctgactcagccccactctgtgtcggagtctccggggaagacggtaaccatctcctgcacccgcagcagtggcagcattgccagcaactatgtgcagtggtaccagcagcgcccgggcagtgcccccacgactgtgatctatgaggataaccaaagaccctctggggtccctgatcggttctctggctccatcgacagctcctccaactctgcctccctcaccatctctggactgaggcctgacgacgaggctgactactactgtcagtcttgtgataacaacaatcatggagtcttcggaactgggaccaaggtcaccgtcctag

SEQ ID NO: 8214 - DNA, 322 bp, Artificial Sequence
  Synthetic construct
gccatccggatgacccagtctccatcctcactctctgcatcgacaggagacagtgtcaccatcacttgtcgggcgagtcagggtattagtaattatttagcctggtatcagcagaaaccagggaaggcccctaaactcctcgtctattctgcatccactttgcaaactggggtcccatcaaggttcattggcagtggatctgggacagatttcactctcaccatcacctccctgcagtctgaagattttgcatcctattactgtcagcagtattatgatgaccccctcactttcggcggagggaccaaggtggacatcacac

SEQ ID NO: 8215 - DNA, 331 bp, Artificial Sequence
  Synthetic construct
cagtctgtgttgacgcagccgccctcagtgtctgcggccccaggacagaaggtcaccatctcctgctctggaagcggctccaacattgggaataattatgtatcctggtaccaacaattcccaggcacagcccccaaactcctcatttatgacaatagtaggcgaccctcagggattcctgaccgattctctggttccaagtctggcacgtcagccaccctggacatcaccggactccagactggggacgaggccgattattactgcggaacatgggatagcagcctgagtgctgaggtcttcggcggagggactaagctgaccgtcctaa

SEQ ID NO: 8216 - DNA, 224 bp, Artificial Sequence
  Synthetic construct
acactggtaccagcacaaaccagatcagtctccaaaactgctcatcaagtatgcttcccagtccatttcaggggtcccctcgaggttcagtggcagtggatccgggacagatttcaccctcaccatcaatggcctggaacctgaagatgctgcaacgtattactgccatcagagtagtgccttaattcaaacttttggccaggggaccaagctggagatcaaac

SEQ ID NO: 8217 - DNA, 322 bp, Artificial Sequence
  Synthetic construct
gccgtccggatgacccagtctccttcttccctgtctgcatctacaggagacagagtcacaatcacttgtcgggcgagtcaaggagttagtagttatgtagcctggtatcagcaaaaaccgggagaagtccctaagctcctgatctatgctgcatccactttgcaaagaggggtcccatcaaggttcagtggcagtggatctgggacagaattcactctcaccatcagttgcctgcagtctgaggattttgcaacttactactgtcagcagtattacacttcccctctgactttcggccctgggaccaaagtggatgccaaac

SEQ ID NO: 8218 - DNA, 319 bp, Artificial Sequence
  Synthetic construct
tcatatgcgatgactcagccaccctcagtgtccgtgtccccaggacagacagccagcatcacctgttatggagataaactgggggataaatttgttacctggtatcagcagaagccaggccagtcccctgtgttggtcatgtatcaagatagtaagcggccttcagggatccctgagcgattctctggctccaactctgggaacacagccactctgaccatcagcgggacccaggctatggatgaggctgcctattactgtcaggcgtgggacagcagcactgccgttttcggcggagggaccaagctgaccgtcctaa

SEQ ID NO: 8219 - DNA, 325 bp, Artificial Sequence
  Synthetic construct
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattttccttggacgttcggccaagggaccaaggtggaaatcaaac

SEQ ID NO: 8220 - DNA, 322 bp, Artificial Sequence
  Synthetic construct
gacatccagatgacccagtctccatcctccctgtctgcatctgtaggagacagagtcaccatcacttgccgggcaagtcagagcattagcacctatttaaattggtatcagcagaaaccggggaaagcccctaggctcctgatctatgctacattcactttgcacagtggggtcccttccaggttcagtggcagtggatctgggacagatttcactctcaccatcagcagtctgcaacctgaagattttgcaacttactactgtcaacagagttttagtaggcctccaactttcggccctgggaccacagtggatatcaaac

SEQ ID NO: 8221 - DNA, 331 bp, Artificial Sequence
  Synthetic construct
cagtctgccctgactcagcctgcctccgtgtctgggtctcctggacagtcgatctccatctcctgcactggatccagcagtgatgttgggacctatgactttgtctcctggtaccaacagcacccaggcaaagcccccaaactcataattcatgaggtcaataagcggccctctggggtttctaatcgcttctctggctccaagtctggcaacacggcctccctgacaatctctgggctccaggctgaagacgaggctgattattactgctgctcatatgcaggtagtagaacttctttcttcggaactgggaccaaggtcaccgtcctaa

SEQ ID NO: 8222 - DNA, 331 bp, Artificial Sequence
  Synthetic construct
cagtctgccctgactcagcctgcctccgtgtctgggtctcctggacagtcgatctccatctcctgcactggatccagcagtgatgttgggacctatgactttgtctcctggtaccaacagcacccaggcaaagcccccaaactcataattcatgaggtcaataagcggccctctggggtttctaatcgcttctctggctccaagtctggcaacacggcctccctgacaatctctgggctccaggctgaggacgaggttgattattactgctgctcatatgcaggtagtagaacttctttcttcggaactgggaccaaggtcaccgtcctaa

SEQ ID NO: 8223 - DNA, 157 bp, Artificial Sequence
  Synthetic construct
ggggtttctaatcgcttctctggctccaagtctggcaacacggcctccctgacaatctctgggctccaggctgaagacgaggctgattattactgctgctcatatgcaggtagtagaacttctttcttcggaactgggaccaaggtcaccgtcctaa

SEQ ID NO: 8224 - DNA, 322 bp, Artificial Sequence
  Synthetic construct
gaaattgtgttgacacagtctccagccaccctgtctttgtctccaggggaaagagccaccctctcctgcagggccagtcagagtattagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtggcaactggccgatcaccttcggccaagggacacgactggagattaaac

SEQ ID NO: 8225 - DNA, 334 bp, Artificial Sequence
  Synthetic construct
cagtctgccctgactcagcctgcctccgtgtctgggtctcctggacagtcgatcaccatctcctgcactggaaccaacagtgatgttgggagttataaccttgtctcctggtaccaaaaccacccaggcaaagcccccaaactcatgatttatgatgtcagtaatcggccctcagggatttctaatcgcttctctggctccaagtctggcaacacggcctccctgacaatctctgggctccaggctgacgacgaggctgattattactgcacctcatatacaaacaacagctattctcaggtattcggcggagggaccaagctgaccgtcctag

SEQ ID NO: 8226 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtgcccctcgtacttttggccaggggaccaagctggagatcaaac

SEQ ID NO: 8227 - DNA, 334 bp, Artificial Sequence
  Synthetic construct
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataaccgaccctcagggattcctgaccgattctctggctccaagtctggcacgtcagccaccctgggcatcaccggactccagactggggacgaggccgattattactgcggaacatgggataacagcctgagtgctggctatgtcttcggaactgggaccaaggtcaccgtcctag

SEQ ID NO: 8228 - DNA, 337 bp, Artificial Sequence
  Synthetic construct
cagtctgccctgactcagcctgcctccgtgtctgggtctcctggacagtcgatcaccatctcctgcactggaaccaacagtgatgttgggagttataaccttgtctcctggtaccaaaaccacccaggcaaagcccccaaagtcttgatttatgagggcagtaagcggccctcaggggtttctaatcgcttctctggctccaagtctggcacgtcagccaccctgggcatcaccggactccagactggggacgaggccgattattactgcggaacatgggataacagcctgagtgctggctatgtcttcggaactgggaccaaggtcaccgtcctag

SEQ ID NO: 8229 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataagaactccttagcttggtaccagcagaaaccaggacagcctcctcagctcctcatttactgggcatctacccgggaatccggggtccctgaccgattcagtggcagcgggtctgggacagatttcactctcaccatcagcagcctgcaggctgaagatgtggcagtttattactgtcagcaatattatactactcctctgacgttcggccaagggaccaaggtggaaatcaaac

SEQ ID NO: 8230 - DNA, 331 bp, Artificial Sequence
  Synthetic construct
cagtctgccctgactcagcctgcctccgtgtctgggtctcctggacagtcgatcaccatctcctgcactggaaccagcagtgacgttggtgcttataactatgtctcctggtaccaacagcacccaggcaatgcccccaaactcatgatttatgatgtcagtgatcggccctcaggggtctctaatcgcttctctggctccaagtctggcaacacggcctccctgactatctctgggctccaggctgaggacgaggctgattattactgcatctcatatacaactagcagcacttgggtgttcggcagagggaccaaggtgaccgtcctag

SEQ ID NO: 8231 - DNA, 319 bp, Artificial Sequence
  Synthetic construct
tatgatgagctggctcagccaccctcactgtccgtgtccccaggacggacagccaccatcacctgctctggagataaattgggggctagatttacttgctggtatcaacagaaggcaggccagtcccctgttctggtcatctatcaagattccaagcggccctcagggatccctgagcgattctctggctccaactctggggacacagccactctgaccatcaccgggacccagccgacggatgaggctgtctattactgtcaaacgtgggacagcaccactgcggtgttcggcggagggaccgagctgaccgtcctag

SEQ ID NO: 8232 - DNA, 337 bp, Artificial Sequence
  Synthetic construct
gatgttgtgatgactcagtctcccctctccctgcccgtcacccttggacagccggcctccatctcctgcaggtctaatcaaaacctcgtacacagtgatggaagcacctacttaaattggtatcaacagaggccaggccaatctccaaggcgcctcgtttataaggtttctaatcgggactctggggtcccagacagattcagcggcagtgggtcaggcactgacttcacactggaaatcagcagcgtggaggctgaggatgttggggtttattactgcatgcaaggttcacactggccattcactttcggccctgggaccaaactggatatcaagc

SEQ ID NO: 8233 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactctgtacacttttggccaggggaccaagctggagatcaaac

SEQ ID NO: 8234 - DNA, 322 bp, Artificial Sequence
  Synthetic construct
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccttggacttttggccaggggaccaagctggagatcaaac

SEQ ID NO: 8235 - DNA, 337 bp, Artificial Sequence
  Synthetic construct
gacatcgtgatgacccagtctccagactccctggctgtgtctctgggcgagagggccaccatcacctgcaagtccagccagagtcttttatacacctccaacaataagaactacttagcttggtaccagcagaaacccggacagcctcctgaactgctcatttactgggcatctacccgggaatccggggtccctgaccgattcagtggcagcgggtctgggacagatttcactctcaccatcagcagcctgcaggctgacgatgtggcagtttattactgtcagcaatattatagttctatcaccttcggccaagggacacgactggagattaaac

SEQ ID NO: 8236 - DNA, 325 bp, Artificial Sequence
  Synthetic construct
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtactttcgtggtattcggcggagggaccaagctgaccgtcctag

SEQ ID NO: 8237 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccattcactttcggccctgggaccaaagtggatatcaaac

SEQ ID NO: 8238 - DNA, 322 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcccctcactttcggcggagggaccaaggtggagatcaaac

SEQ ID NO: 8239 - DNA, 322 bp, Artificial Sequence
  Synthetic construct
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcaaacttttggccaggggaccaagctggagatcaaac

SEQ ID NO: 8240 - DNA, 322 bp, Artificial Sequence
  Synthetic construct
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtcttcggaactgggaccaaggtcaccgtcctag

SEQ ID NO: 8241 - DNA, 325 bp, Artificial Sequence
  Synthetic construct
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctccgctcactttcggcggagggaccaaggtggagatcaaac

SEQ ID NO: 8242 - DNA, 322 bp, Artificial Sequence
  Synthetic construct
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctctcactttcggccctgggaccaaagtggatatcaaac

SEQ ID NO: 8243 - DNA, 328 bp, Artificial Sequence
  Synthetic construct
gaaattgtgttgacgcagtctccaggcaccctgtctttgtctccaggggatagagccaccctctcctgcagggccagtcagagtgtcagcagtgggttcttagcctggtaccagcagaaacctggccaggctcccaggctcctcatctatgaggcatccagcagggccactggcaccccagacaggttcagtggcagtgggtctgggacagagttcactctcaccatcagcagcctgcagtctgaagattttgcagtttattactgtcagcagtatgataactggcctccgatcaccttcggccaggggacacgactggagattaaaa

SEQ ID NO: 8244 - DNA, 328 bp, Artificial Sequence
  Synthetic construct
cagactgtggtgacccaggagccatcgctctcagtgtcccctggaggggcagtgacgctcacttgtggcttgagctctggctcagtctctacctattattatcccagttggttccggcagaccccaggccaggctccacgcacgctcatctacagcacacaccttcgcacttctggggtccctgatcgcttctctggctccattattgggaacaaagctgccctcaccatcacgggggcccaggcagatgatgactgtgactattactgtgtgctgtatctgggtactgtcgtgctcttcggcggagggacaaagctgaccgtcctag

SEQ ID NO: 8245 - DNA, 319 bp, Artificial Sequence
  Synthetic construct
gacatccagatgacccagtctccctccaccctgtctgcatctgtgggagacacagtcaccatcacctgccgggccagtcagagtattaggagttggttggcctggtatcagcagaaaccaggtaaagcccctaaactcctgatctctaaggcgtctgatttacaacctggggtcccatcaaggttcagcggcagtgggtctgggacagaattcactctcaccatcaccagcctgcagcctgatgattttggtacttatcactgccaacaatatgatactctgtggacgttcggccaggggacgaaggtggaaatcaaac

SEQ ID NO: 8246 - DNA, 322 bp, Artificial Sequence
  Synthetic construct
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccgtacacttttggccaggggaccaagctggagatcaaac

SEQ ID NO: 8247 - DNA, 328 bp, Artificial Sequence
  Synthetic construct
caggctgtggtgactcaggagccctcactgactgtgtccccaggagggacagtcactctcacctgtggctccagcactggagctgtcactagtggtcattatccctactggttccagcagaagcctggccaagccccccggacactgatttatgatgcaaactacaaatactcctggacacctgcccgcttctcaggctccctccttgggggcaaagctgccctgaccctttcgggtgcgctgcctgaggatgaggctgactattactgcctgctctcctatagtgatactcgggtcttcggagctgggaccaaggtcaccgtcctag

SEQ ID NO: 8248 - DNA, 337 bp, Artificial Sequence
  Synthetic construct
gacatcgtgttgacccagtctccagactccctggctgtgtctctgggcgagagggccaccatcaactgcaagtccagccagagtgttttattcagtttaaataataagaattacttagcttggtaccagcagaaaccaggacagcctcctaaactgctcatttactgggcatctacccgggaatccggggtccctgaccgattcagtggcagcgggtctgggacagacttcactctcaccatcagcagtgtgcaggctgaagatgtggcaatttattactgtcagcaatttcatacttcttggacgttcggcccagggaccaaggtggaaatcagac

SEQ ID NO: 8249 - DNA, 325 bp, Artificial Sequence
  Synthetic construct
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttattgggtgttcggcggagggaccaagctgaccgtcctag

SEQ ID NO: 8250 - DNA, 340 bp, Artificial Sequence
  Synthetic construct
gagattgtgatgacccagactccactctccttgtctatcacccctggagagcaggcctccatgtcctgcaggtctagtcagagcctcctgcatagtgatggatacacctatttgtattggtttctgcagaaagccaggccagtctccacgctcctgatctatgaagtttccaaccggttctctggagtgccagataggttcagtggcagcgggtcagggacagatttcacactgaaaatcagccgggtggaggctgaggatgttggagtttattactgcatgcaagatgcacaagatcctccgtacacttttggccaggggaccaagctggagatcaaac

SEQ ID NO: 8251 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcgaggttcagtggcagtggatctgggacagatttcactctcaccatcagcagtctgcaacctgaagattttgcaacttactactgtcaacagagttacagtagtcctcggacgttcggccaagggaccaaggtggaaatcaaac

SEQ ID NO: 8252 - DNA, 322 bp, Artificial Sequence
  Synthetic construct
gacatccagatgacccagtctccatcttccgtgtctgcatctgtgggagacagagtcaccatcacttgtcgggcgagtcaggatattagcagctggttagtctggtatcagcagaaaccagggaaagcccctaacctcctgatctatgctgcatccagtttgcaaaatggggtcccatcaaggttcagcggcagtggctctgggacagatttcactctcaccatcagcagcctgcagcctgaagattttgcaacttacttttgtcaacaggccagcagtttcccattcactttcggccctgggaccatagtggatatcaaac

SEQ ID NO: 8253 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaac

SEQ ID NO: 8254 - DNA, 340 bp, Artificial Sequence
  Synthetic construct
gacatcgtgatgacccagtctccagagtccctggctgtgtctctgggcgagagggccaccatcaactgcaagtccagccagagtgttttattcagctccaacaataagaactacttagcttggtaccagcagaaaccaggacagcctccaaagctgctcatttactggtcatctacccgggaatccggggtccctgaccgattcagtggcagcgggtctgggacagatttcactctcaccatcagcagcctgcaggctgaagatgtggcagtttattactgtcagcagtattctagtactccattcactttcggccctgggacctcagtggatatcaaac

SEQ ID NO: 8255 - DNA, 331 bp, Artificial Sequence
  Synthetic construct
cagtctgccctgactcagcctccctccgcgtccgggtctcctgaacagtcagtcaccatctcctgcactggaaccagcagtgacgttggtaattataattatgtctcctggtaccaacaccacccaggcaaagcccccaaactcatgatttatgaggtcaataagcggccctcaggggtccctgatcgcttctctggctccaagtctggcaacacggcctccctgaccgtctctgggctccaggctgaagatgaggctgattattactgcaactcatatgcaggcagcgacaattgggtgttcggcggagggaccaagctgaccgtcttag

SEQ ID NO: 8256 - DNA, 319 bp, Artificial Sequence
  Synthetic construct
gaaatagtgatgacgcagtctccggccatcctgtctgtgtctccaggggaaacagccaccctctcctgcagggccagtcagagaatagccaacaacttggcctggtaccagcagaaacttggccaggctcccaggctcctcatctatgatgcatccactcggcccactgggatcccagccaagttcaggggcagtgggtctgggacagaattcactctcaccatcgtcagcctccagtctgaagattttgcagtttattactgtcagcagtatcatttctggccttcgttcggccgagggaccaaggtggaaatcaagc

SEQ ID NO: 8257 - DNA, 331 bp, Artificial Sequence
  Synthetic construct
cagtctgtgctgactcagccaccctcagcgtctggtacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttgggtgttcggcggagggaccaagctgaccgtcctag

SEQ ID NO: 8258 - DNA, 337 bp, Artificial Sequence
  Synthetic construct
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaacccagatcaccttcggccaagggacacgactggagattaaac

SEQ ID NO: 8259 - DNA, 328 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgcagatcaccttcggccaagggacacgactggagattaaac

SEQ ID NO: 8260 - DNA, 331 bp, Artificial Sequence
  Synthetic construct
cagtctgccctgactcagcctgcctccgtgtctgggtctcctggacagtcgatcaccatctcctgcactggaacgaacagtgacgttggtggttatgagtatgtcacctggtaccaacagcacccaggcaaagcccccaaagtcatgatttatgaggtcaggaatcggccctcaggagttgctcatcggttctctggctccaagtctggcaacacggcctccctgaccatctctgggctccaggctgaggacgaggctgattattactgcagctcatatgcaagcgacaccagtctggtgttcggcggagggaccaagctgaccgtcctaa

SEQ ID NO: 8261 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactgtggacgttcggccaagggaccaaggtggaaatcaaac

SEQ ID NO: 8262 - DNA, 322 bp, Artificial Sequence
  Synthetic construct
gacatccagatgacccagtctccttccaccctatctgcatctgttggagacagagtcaccatcacctgtcgggccagtcagagtattagtacctggttggcctggtatcagcagaaaccagggaaagcccctaaactcctcatctataaggcgtctactttaaatagtggggtcccgtcgaggttcagcggcagtggatctgggacagacttcaccctcaccatcagcagcctgcagcctgatgattttgcaacttattactgccagcaatttaatctttatcccctcactttcggcggagggaccaacgttgagatgaaac

SEQ ID NO: 8263 - DNA, 325 bp, Artificial Sequence
  Synthetic construct
tcttctgagctgactcaggaccctgctgtgtctgtggccttgggacagacagtcaggatcacatgccaaggagacagcctcagaagctattatacaagctggtaccagcagaagccaggacaggcccctgtacttgtcatctatggtaaaaacaaccggccctcagggatcccagaccgattctctggctccacctcaggaaacacagcttccttgaccatcactggggctcaggcggaagatgaggctgactattactgtaactcccgggacagcagtggtaaccatgtggtattcggcggagggaccaagctgaccgtcctgg

SEQ ID NO: 8264 - DNA, 331 bp, Artificial Sequence
  Synthetic construct
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctataggaataatcagcggccctcaggggtccctgaccgattctctggctccaagtctggcacctcagcctccctggccatcagtgggctccaggctgaggatgaggctgattattactgtgcagcatgggatgacagcctgaatggtgtggtattcggcggagggaccaagctgaccgtcctag

SEQ ID NO: 8265 - DNA, 334 bp, Artificial Sequence
  Synthetic construct
cagtctgccctgactcagcctgcctccgtgtctgggtctcctggacagtcgataaccatctcctgcactggaaccagcagtgacgttggtgattatgactatgtctcctggtaccaacaacacccaggcaaagcccccaaactcataatttatgatgtcactaatcgaccctcgggggtttctaatcgcttctctggctccaagtctggcaacacggcctccctgaccatctctgggctccaggctgaggacgagggtgactattactgcaactcatacacaagcaccaccactcttgtacttttcggcggcgggaccaagctgaccgtcctaa

SEQ ID NO: 8266 - DNA, 325 bp, Artificial Sequence
  Synthetic construct
gaagttgtgttgacgcagtctccaggcaccctgtctttgtctccaggggaaagagccaccctctcctgcagggccagtcagagtgttagtaacaattacttagcctggtaccagcagaaacctggccagcctcccaggctcctcatctatgctgcttccagcaggaccactggcatcccagacaggttcagtggtggtgggtctgggacagacttcactctcaccatcagcagactggagcctgaagattttgcagtgttttactgtcaccagtatggtgactcaccgtggacgttcggccaagggaccaaggtggaaatcaaac

SEQ ID NO: 8267 - DNA, 322 bp, Artificial Sequence
  Synthetic construct
gacatccagatgacccagtctccatcctcactgtctgcatctgttggagacagagtcaccatcacttgtcgggcgagtcagggcattagcgattatttagcctggtttcagcagaagccagggaaagcccctaagtcactaatttattctacatctcaattgcaaaggggggtcccatcaaggttcagcggctggggatatgggaaaaatttcactctcaccgtcagcagcctgcagcctgaagattttgcaatttattactgtcaacagtataatgcttatccgatcaccttcggccaagggacacgactggatattaagc

SEQ ID NO: 8268 - DNA, 325 bp, Artificial Sequence
  Synthetic construct
tcctatgtgctgactcagccaccctcggtgtcagtggccccaggacagacggccaggattacctgtgggggaaacaacattggaagtcggagtgtccactggtaccagcagaggccaggccaggcccctgtactggtcgtctctgatgatagcgaccggccctcagggatccctgagcgattctctggctccaactctgagaacacggccaccctgaccatcagcagggtcgaagccggggatgaggccgactatttctgtcaggtgtgggatactgcttctgatcattatgtcttcggagctgggaccaaggtcaccgtcctag

SEQ ID NO: 8269 - DNA, 322 bp, Artificial Sequence
  Synthetic construct
gaaacagtgatgacgcagtctccagccaccctgtctgtgtctccaggggatagagcccccctctcctgcagggccagtcagagtgttagtaccaacttagcctggtaccagcagaaacctggccaggctccccggctcctcatctatggtgcatccaccagggccactggtatcccagccaggttcagtggcagtgggtctgggacagaattcactctcaccatcagcagcctgcagtctgaagattttgcagtttattactgtcagcagtataataactggccccggacgttcggccaagggaccaaggtggaagtcaagc

SEQ ID NO: 8270 - DNA, 156 bp, Artificial Sequence
  Synthetic construct
tttctaatcgcttctctggctccaagtctggcaacacggcctccctgaccatctctgggctccaggctgacgacgaggctgattattactgcacctcatatacaaacgacaccaattctcaggtattcggcggagggaccaagctgaccgtcctag

SEQ ID NO: 8271 - DNA, 325 bp, Artificial Sequence
  Synthetic construct
gaaatagtgatgacgcagtctccagccaccctgtctgtgtctgcaggggaaacagccaccctttcctgcagggccagtcagagtgttaggagccacttggcctggtaccagcagaggccaggccagcctcccaggctcctcatctttggtgcatccaccagggccactggtgtcccagccaggttcagtggcagtgggtctgggacagagttcactctcaccatctacagcctccagtctgaagactttgcagtctactactgtcagcagtacaataattggcctccttacacttttggccaggggaccaagttggaggtcaaac

SEQ ID NO: 8272 - DNA, 328 bp, Artificial Sequence
  Synthetic construct
cagtctgccctgactcagcctgcctccgtgtttgggtctcctggacagtcgatcaccatctcctgcactggaaccagcagtgatgtggggacttattcccttgtcacctggtaccaacaactcccagggaaagcccccaaactcttaatttttgacgtcaataagcggccctcaggtgtttctaatcgcttctctggctccaagtccggcaacacggcctccctgacaatctctggactccaggctgaggacgaggctgattattattgctgctcatatgcaggcgctacttatgtcttcggaagtgggacccaggtcatcgtcctag

SEQ ID NO: 8273 - DNA, 328 bp, Artificial Sequence
  Synthetic construct
cagtctgccctgactcagcctgcctccgtgtttgggtctcctggacagtcgatcaccatctcctgcactggaaccaacagtgatgttgggagttataaccttgtctcctggtaccaaaaccacccaggcaaagcccccaaagtcttgatttatgagggcagtaagcggccctcaggggtttctaatcgcttctctggctccaagtccggcaacacggcctccctgacaatctctggactccaggctgaggacgaggctgattattattgctgctcatatgcaggcgctacttatgtcttcggaagtgggacccaggtcatcgtcctag

SEQ ID NO: 8274 - DNA, 340 bp, Artificial Sequence
  Synthetic construct
gacatcgtgatgacccagtctccagactccctggctgtgtctctgggcgagagggccaccatcaactgcaggtccagcctgagtgttttttataagtacaacaataacaactacttagcttggtaccagcagaaaccaggacagcctcctaagctgctgttttactgggcatctacccgggaatccggggtccctgaccgattcactggcagcgggtctgggacagaattcactctcaccataagcagcctgcaggctgaagatgtggcagtttattactgtcagcaatattatactactcccctcactttcggcccggggaccagagtggatatcaaac

SEQ ID NO: 8275 - DNA, 325 bp, Artificial Sequence
  Synthetic construct
tcctctgtcctgactcagccaccctcggtgtcagtggccccggggcagacggccaggattccctgtgacttaaacaatgttgaagttaggagtgtacattggtaccagcacaaggcgcgccaggccccagtactggtcgtctatgatgatagtgtccggccctcagggatccctgagcgattctccggctccctgtcctcggacacggccaccctgaccatcagcaggatcgaggccggggatgaggccgactattattgtcaggtgtgggacagtattagtaatcaggtgattttcggcggtgggaccgagctgaccgtcctag

SEQ ID NO: 8276 - DNA, 325 bp, Artificial Sequence
  Synthetic construct
gaaatagtgatgacgcagtctccagccaccctgtctgtgtctccaggggaaggagccgtactctcctgcagggccagtcacagcattatgaccaacttagcctggtaccagcagaaacctggccaggttcccaggctcctcttctatggtgcatccaccagggccactggcacccccgcccgattcattggcagtgggtctgggacagacttcactctcaccatcagcgacctgcagtctgaagactttggtgtttattactgtcagcagtatcatgcgtggcccccgctcaccttcggcggagggaccaaggtggagatcactc

SEQ ID NO: 8277 - DNA, 328 bp, Artificial Sequence
  Synthetic construct
gaaatagtgatgacgcagtctccagccaccctgtctgtgtctccaggggaaagagtcaccctctcctgcagggccagtcagaatattgtcaatactttagcctggtaccagcagaaacctggccaggctcccaggctcctcatatatgatgcctctaccagggccactggtttcccagccaggttcagtggcagtgggtctgggacagagttcactctcaccatcagcagccttcagtctgaagactttgcagtttattattgtcagcagtacagtaagtggcctccggggttcactttcggccaggggaccaagttggagatcaaac

SEQ ID NO: 8278 - DNA, 328 bp, Artificial Sequence
  Synthetic construct
gaaattgtgttgacacagtctccagtcaccctgtctgtgtctccaggggaaagagccaccctctcctgcagggccagtcagagtgttaacagcgacttagcctggtaccaacagaaacctggccgggctcccaggctcctcatctatgatgcatccaacagggcctcgggcatcccagccaggttcagtggcagtgggtctgggacagacttcagtctcaccatcagcagcctagagcctgaagattgtgcagtttattactgtcaacagcgaagcaactggcctccgagtctcactttcggcggagggaccaaggtggagatcaaac

SEQ ID NO: 8279 - DNA, 319 bp, Artificial Sequence
  Synthetic construct
gaaatagtgatgacgcagtctccagccaccctgtctgtgtctccaggagaaagagccaccctctcctgcagggccagtcagagaatcagtagcaacttagcctggtaccagcagagacctggccaggctcccaggctcctcatctttggtgcatccaccagggccaccggtatcccagccaggttcagtggcagtgggtctgggacagagttcactctcaccatcagcagcctgcagtctgacgattttgcagtttattactgtcagcagtacaatagagggtggacgttcggccaagggaccaaggtggacatcaaac

SEQ ID NO: 8280 - DNA, 322 bp, Artificial Sequence
  Synthetic construct
gacatccagatgacccagtctccatcctccctgtctgcatctgtaggagacagagtcaccatcacttgccgggcaagtcagagcattaacagttatttaaattggtatcagcagaaaccagggaaagcccctaagctcctgatccatactgcatccagtttgcaaagtggggtcccatcaaggttcagtggcagtggatctgggacagatttcactctcaccatcagcagtctgcaacctgaggattttgcaacttactcctgtcaacagagttacaatatacccctcactttcggcggagggaccaaggtggagatcaaac

SEQ ID NO: 8281 - DNA, 331 bp, Artificial Sequence
  Synthetic construct
cagtctgtgttgacgcagccgccctcagtgtctgcgaccccaggacagaaggtcaccatctcctgctctggaagcagctccaacattgggaatcattatgtatcctggttccagcagctcccaagtagagcccccaaactcctcatctatgaaaataataagcgaccctcagggattcctgaccgattctctggctccaagtctggcacgtcagccaccctgcacatcaccggactccagactggggacgaggccgattattactgcggaacatgggatagcagcctgagtgctggactcttcggacctgggaccaaggtcaccgtcctag

SEQ ID NO: 8282 - DNA, 319 bp, Artificial Sequence; identical to SEQ ID NO: 1830
  Synthetic construct

SEQ ID NO: 8283 - DNA, 322 bp, Artificial Sequence
  Synthetic construct
gacatccagatgaaccagtctccatcttcactgtctgcatctgttggagacagcgtcaccatcacttgtcgggcgagtcaggctattgacaattttttagcctggtttcagcagaaacctgggaaagcccctaagtccctgatctatggtgcatccactttgcagagtggggtcccatcaaagttcagcggcagtggctctgggaccgatttcactctcaccatctccggcctgcagcctgatgattctgcaacttattactgccaacagtataatcattaccctttcaccttcggccaagggacacgactggagattaaac

SEQ ID NO: 8284 - DNA, 340 bp, Artificial Sequence
  Synthetic construct
gagatcgtcctgacccagtctccagactccctggctgtgtccctgggcgacagggccaccatcacctgcacctccaatcaaagtgttttgttcgcgtccaacggtcggaatttcatagcctggtaccagcagagaccgaggcgaccgcctactcttctcatctacttggcttctactcgaaaatccggggtccctgagcgattcgctgccggcgggtctgacacaaggttctctctcaccatcgcccctgtccagagtgaagacgtggcgacttattactgtcaccagtattatagtactccgtccacttttggccaggggaccagactggagatcaagc

SEQ ID NO: 8285 - DNA, 322 bp, Artificial Sequence
  Synthetic construct
gacatccagatgacccagtctccttccaccctgtctgcatctgtaggagacagagtcaccatcacttgccgggccagtgagagtattagtgactggctggcctggtatcagcagaaaccagggaaagcccctaagctcctgatctataaggcatctaatttaaaaagtggggtcccatcaaggttcagcggcagtggatctgggacagagttcactctcaccatcagcagcctgcagcctgatgattttgcaacttattactgccaacagtttaatagttacacgtggacgttcggccaagggaccaaggtggaagtcagac

SEQ ID NO: 8286 - DNA, 322 bp, Artificial Sequence
  Synthetic construct
tcctatgagctgactcagccaccctcagtgtccgtgtccccaggacagacagccagcatcacctgtattggagataaattggaggatgaatatgttttctggtatcagcagaagccaggccagtcccctgtcctggtcatctatcaggattctgagcggccctcagggatccctgagcgattctctggctccaactctgggcacacagccactctgaccatcagcgggacccaggctgtggatgaggctgagtattactgtcaggcgtgggacagcagttccctttatgtcttcgggactgggaccaaggtcaccgtcctag

SEQ ID NO: 8287 - DNA, 328 bp, Artificial Sequence
  Synthetic construct
gaagttgtgttgacacagtctccagccaccctgtctttgtctccaggggaaagagccaccctctcctgcagggccagtgagagtgttagtagttacttagcctggtatcaacagaaacctggacaggcgcccaggctcctcatttatgatacttccatcagggccactggcgtctcagacagattcagtggcagggggtctgggacagacttcactctcaccatcagccacgtagagcctgaagattttgcactttattattgtcaacaggggaccgactggcctcacctattcactttcggccctgggaccagagtggagatcagac

SEQ ID NO: 8288 - DNA, 319 bp, Artificial Sequence
  Synthetic construct
caaattgtgttgacacagtctccagccaccctgtctttgtctccaggggaaagagccaccctctcctgcagggccagtcagagtattagcgcctccttagcctggtaccaacagaaacctggccaggctcccaggctcctcatctttgatgctttcaacagggccactggcatcccagccaggttcagtggcagtgggtctgggacagacttcactctcaccatcagtagcctggagcctgaagattttgcagtttattactgtcagcagcatttcagctggatcaccttcggccaagggacacgactggagattaaac

SEQ ID NO: 8289 - DNA, 337 bp, Artificial Sequence
  Synthetic construct
gatgttgacctgactcagtctccgctcgtcctgcccgtcgcccttggtcagccggcctccatctcctgcaaggctagtcggagtctcgttcacagtgatggggccacgtacttcaattggttccttcagaggccaggccaacctccaaggcgtcttttttatagaatttctaatcgggactctggggtccctgacagattaagcggcagtggatcaggcactgattttacattgaaaatcagcagggtggaggctaacgataccggaatgtatttttgtatgcagggcacacactggccgctcactttcggcggggggaccatcctggagatcagac

SEQ ID NO: 8290 - DNA, 322 bp, Artificial Sequence
  Synthetic construct
gacatccagatgacccagtctccatcctccctgtccgcatctgtaggggacaaagtcaccatcacttgccgggcaagtcagagcattagcaactatttaaattggtatcttcagaaaccagggaaagcccctaacctcttaatctatggtgcctccagtttgcaaagtggggtcccattaaggttcagtggcagtgggtctgggacagatttcactctcaccatcagcaatctgcaacctgaagattttgcaacttactactgtcaacagagtttcagaaccccgtacacttttggccaggggaccaaggtagagatcaaac

SEQ ID NO: 8291 - DNA, 331 bp, Artificial Sequence
  Synthetic construct
cagtctgtgttgactcagccaccctcagcgtctgggacccccgggcagagggtctctatttcttgtcatggaagcagctccaacatcggtaacaatcctgttttctggtaccagctcctcccaggaacggcccccagactcctcatgtctagtcatattcagcgaccctcaggggtccctgaccgattctctggctcccagtctggcacctcagcctccctggccatcagtgggctccagtctgaggatgagggtttttatttctgtgccacatgggacgacagcctgactggctatgtcttcgggactgggaccaaggtcaccgtcctag

SEQ ID NO: 8292 - DNA, 331 bp, Artificial Sequence
  Synthetic construct
caggcagggctgactcagccaccctcggtgtccaagggcttgagacagaccgccacactcacctgcactgggaacagcaacaatgttggcaaccaaggagcagcttggctgcagcagcaccagggccaccctcccaagctcctatcctacaggaataataaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctag

SEQ ID NO: 8293 - DNA, 322 bp, Artificial Sequence
  Synthetic construct
gacatccagatgacccagtctccttccaccctgtctgcatctgttggagacagagtcaccatcacttgccgggccagtcagagtatttataactggttggcctggtatcagcagaaaccagggaaagcccctaagctcatgctccataaggcgtcaagtttagagagtggggtcccatcaaggttcagcggcagtggatctgggacagaattcactctcaccatcagcagcctgcagcctgatgattttgcaacttattactgtcaacagtatagtagttatccgttcacgtttggccaggggaccaagttggagagcaaac

SEQ ID NO: 8294 - DNA, 334 bp, Artificial Sequence
  Synthetic construct
cagtctgccctgactcagcctgcctccgtgtctgggtctcctggacagtcgatcaccatctcctgcactggaaccagcagtgacattggtgcctatgactatgtctcctggtaccaacaacagccaggcaaagcccccaaactcctgatttttgccgtcagtgatcggccctcagggatttctgatcgcttctctggctccaggtctggcaacacggcctccctgtccatctctgggctccaggctgttgacgaggctgattactactgctcttcatacataagaggcaccgcttcttttgtcttcggaactgggaccacggtcaccgtcctac

SEQ ID NO: 8295 - DNA, 325 bp, Artificial Sequence
  Synthetic construct
gaaatagtgatgacgcagtctccagccaccctgtcagtgtctccaggggaaagagccaccctctcctgctgggccggtcagagtgttggcagcagcttagcctggtaccatcagaaacctggccaggcgcccaggctcctcatatatggtgcatccactagggccactggtgtcccagccaggatcagtggcagtgggtctgggacagagttcactctcaccatcagcagcctgcagtctgaagattttggagtttattactgtcagcactatagtgactggcctccggtaacttttggccaggggaccaagctggagatcaaac

SEQ ID NO: 8296 - DNA, 334 bp, Artificial Sequence
  Synthetic construct
gacattgtgctgactcagtctccactctccctgcccgtcacccctggagagccggcctccctctcctgcaagtcttcgaagagcctcctgcataatggagacaaccttgtggattggttcctgcagaagccagggcagtctccacagctcgtcatccacttggcttctaatcgggcctccggggtccctgacaggttcagtggcaggggatcaggcacagattttatactgacaatcagtagagtggaggctgaggatgttggggtgtacttctgcatgcaaactctccaagctccgtacacttttggccaggggaccaagctggagatcaaac

SEQ ID NO: 8297 - DNA, 334 bp, Artificial Sequence
  Synthetic construct
cagtctgccctgactcagcctgcctccgtgtctgggtctcctggacagtcgatcaccatctcctgcactggaaccaacagtgatgttgggagttataaccttgtctcctggtaccaaaaccacccaggcaaagcccccaaagtcttgatttatgagggcagtaagcggccctcaggggtttctaatcgcttctctggctccaagtctggcaacacggcctccctgacaatctctgggctccaggctgacgacgaggctgattattactgcacctcatatacaaacaacagcaattctcaggtattcggcggagggaccaagctgaccgtcctag

SEQ ID NO: 8298 - DNA, 322 bp, Artificial Sequence
  Synthetic construct
gacatccagatgacccagtctccatcttccgtgtctgcatctgttggagacaaagtcaccttcacttgtcgggcgagtcagggtattagcaactggttagcctggtatcagcagaaaccagggaaacccccaaaactcctgatctctggtgcaaccaccttgcaaagtggggtcccatcaaggttcagcggcagtggatctgggacagattttactctcaccatcaacagcctgcagcctgaagattttgcaacttactattgtcaacaggctaacagtttcccgatcaccttcggccaagggacacgactggaaattaaac

SEQ ID NO: 8299 - DNA, 331 bp, Artificial Sequence; identical to SEQ ID NO: 1833
  Synthetic construct

SEQ ID NO: 8300 - DNA, 322 bp, Artificial Sequence
  Synthetic construct
gacatccagttgacccagtctccatcctccctgtctgcatctgtaggagacagagtcaccatcacttgccgggcaagtcagggcattagaaataatttaggctggtatcagcagaagccagggaaagcccctaagcgcctgatctatgctgcatccagtttgcaaagtggggtcccatcaaggttcagcggcagtggatctgggacagaattcactctcacaatcagcagcctgcagcctgaagattttgcaagttattactgtctccagcacaatagtttcccgctcactttcggcggagggaccaaggtagagatcaaac

SEQ ID NO: 8301 - DNA, 322 bp, Artificial Sequence
  Synthetic construct
gtcatccggatgacccagtctccatcgtcactctctgcatctacgggagacagagtcaccatcacttgtcgggcgagtcaggatgttgattcttatatagcctggtatcaacaaaaaccaggacaaggccctaacctcctaatacactctgcatccactttgcagaccggagtcccacctagattcaatggcagtggatctgggacagatttcactctcaccatcagctgcctgcagtctgaagaccttggaacctattactgtcaacagtatgaaaatctcccactcactttcggcggcgggaccaaggtggagatcaaac

SEQ ID NO: 8302 - DNA, 334 bp, Artificial Sequence
  Synthetic construct
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaaggtctacaaactccgactttcggccctgggaccaaagtggatatcaaac

SEQ ID NO: 8303 - DNA, 340 bp, Artificial Sequence
  Synthetic construct
ggcatcgtgatgacccagtctccagactccctgactgtgtctctgggcgagagggccaccatcaactgcaagtccaaccagtctcttttatacagctccagccataagaacttcttagcttggtaccagcagaaaccagggcagcctcctaagatgctcttttactgggcatctacccgggagtccggggtccctgaccgattcagtggcagcgggtctgggacagatttcactctcaccatcagcagcctgcaggctgaagatgtggccgtttattactgtcagcaatattctagtactctttggacattcggccaagggaccaaggtggaaatcagac

SEQ ID NO: 8304 - DNA, 334 bp, Artificial Sequence
  Synthetic construct
cagtctgtcctgactcagcctccctccgcgtccgggtctcctggacagtcagtcaccatctcctgcactggagccagcagtgaccttagtgtctacaactctgtctcctggtaccaacagcgcccaggcgaagcccccaaactcttgatttatgaagtcgttaagcggccctcagggatccctgatcgcttctctggctcccagtctggcaacacggcctccctgaccgtctctgggctccaggctgaggatgaggctcattatttctgcagctcatatgcaaccagcgacaatttaagattgtttggtggagggaccaggctgaccgtcgtag

SEQ ID NO: 8305 - DNA, 337 bp, Artificial Sequence
  Synthetic construct
gacatcgtgttgacccagtctccagactccctggctgtgtctctgggcgagagggccaccatcagttgcaagtccagtcagagtgttttatacacctccaataataagaactatttagcctggtaccagcagaagccaggacagcctcctaggttgctcatttactgggcatctacccgggaatccggggtcccagaccgattcattggcagcgggtctgggacagatttcactctcaccatcagcaccctgcaggctgaagatgtggcggtttatttctgtcagcaatattttattactccgactttcggcggagggacctcggtggagagaaaac

SEQ ID NO: 8306 - DNA, 325 bp, Artificial Sequence
  Synthetic construct
gacatccagatgacccagtctccttccaccctgtctgcctctgtaggagacagagtcagcatcacttgccgggccagtcagggaattggtacttggttggcctggtttcagcagaaaccagggaaagcccctaggctcctgatctataaggcatctactttagaaagtggggtcccatcaagattcagcggcagtggatctgggacagacttcactctcaccatcagcagcctgcagcctgatgattttgcaacttattactgccaagaatataatagttaccctatgtacacttttggccaggggaccaggctggagatcaaac

SEQ ID NO: 8307 - DNA, 322 bp, Artificial Sequence
  Synthetic construct
gacatccagatgacccagtctccttccaccctgtctgcatcggtaggagacagagtctccatcacttgccgggccagtcagagtattaataactgggtggcctggtatcagcagagaccagggaaagcccctaaggtcctgatctctcatgcgtctagtttacaaagtgacgtcccgccaaggttcagcggcagtggatctgggacagaattcactctcaccatcagcagcctgcagcctgatgattttgcaacttattactgccaacagtacagtacttatttcgtcactttcggcggggggaccaaggtggagatcaaac

SEQ ID NO: 8308 - DNA, 322 bp, Artificial Sequence
  Synthetic construct
gacatccagatgacccagtctccatcctccctgtctgcatctgtaggagacagagtcacgatcacttgccgggcaagtcagagcattaggacctatttaaattggtatcagcagaaacctgggaaagcccctaagttcctgatctattctgcatccactttgcaaagtggggtcccatcaaggttcagtggcagtggatctgggacagatttcactctcaccatcagtagtctgcaacctgaagattttgcaacttactactgtcaacagagttacagtcccccgttcacttttggccgggggaccaagttggagatcaaac

SEQ ID NO: 8309 - DNA, 328 bp, Artificial Sequence
  Synthetic construct
acctatgtactgactcagccaccctcagtgtcagtggccccaggaatgacggccaggattacctgtgggggagacaacgttggaactcaaaatgtgcactggtaccagcagaagccaggccaggcccctgtgttggtcgtctatagtgacagtaatcggccctcagggatccctgagcgattctctggctccaactctggaaacacggccaccctgagcatcagtggggtcgaagccggggatgaggccgactacttctgtcaggtgtgggatagtactggtgttcacccttttgtcttcggacctgggacccaggtcaccgtcctag

SEQ ID NO: 8310 - DNA, 331 bp, Artificial Sequence
  Synthetic construct
cagtctgtgttgacacagccgccctcagtgtctgcgtccccaggacagaaggtcaccatctcctgctctggaaccagctccaacattggcaataactatgtgtcctggtatcagcaactccctggaacagcccccacactcctcatttatgacaataataagcgaccctcaggacttcctgaccgattctctggcgccaagtctggcacgtcagccaccctggccatcaccggactccagactggggacgaggccgattactactgcggaacgtgggatgacagcctgaatgctggcgtcttcggacctgggaccaaggtcatcgtccttg

SEQ ID NO: 8311 - DNA, 325 bp, Artificial Sequence
  Synthetic construct
aaaattgtgttgacgcagtctccaggcaccctgtctttgtctccaggggaaagagccaccctctcctgcagggccagtcagctttttagcggcagctatttatcttggttccagcagaaacctggtcaggctcccaggctcctcgtctatggtatctccaacagggccactggcatcccagacaggttcagtgccagtgggtctgggacagacttcactctcaccatcagcagactggaccctgaagattttgcagtgtattactgtcagctgtattttggttcaggattcactttcggccctgggaccaaggtggatatcaaac

SEQ ID NO: 8312 - DNA, 213 bp, Artificial Sequence
  Synthetic construct
acccaggcaaagcccccaaactcatgatttatgatgtcagtaatcggccctcagggatttctaatcgcttctctggctccaagtctggcaacacggcctccctgacaatctctgggctccaggctgacgacgaggctgattattactgcacctcatatacaaacgacagcaattctcaggtattcggcggagggaccaagctgaccgtcctag

SEQ ID NO: 8313 - DNA, 325 bp, Artificial Sequence
  Synthetic construct
gaaattgtgttgacacagtctccaggcaccctgtctttgtctccaggggaaggagccagcctctcctgcagggccagtcagagtgtcactaacgactatttagcctggtaccagcagagacctggccaggctcccaggctcctcatctatagtgcctccaccagggccactggcatcccagacaggttcggtggcagtgggtctgggacagacttcactctcaccatcagcaaactggagcctgaagattttgcagtgtatttctgtcagcagtatggcagatcccctcggacgttcggccaagggaccaaggtggaaatcaaac

SEQ ID NO: 8314 - DNA, 337 bp, Artificial Sequence; identical to SEQ ID NO: 1829
  Synthetic construct

SEQ ID NO: 8315 - DNA, 331 bp, Artificial Sequence
  Synthetic construct
cagtctgccctgactcagcctccctccgcgtccgggtctcctggacagtcagtcaccatctcctgcactggaaccaacagtgacgttggtggttataagtatgtctcctggtaccaacaccacccaggcagggcccccaaattcattatgtatgaggtcagtaaacggccctcaggggtccctgatcgcttctctggctccaagtctggcaacacggcctccctgaccatctctgacctcctggctgaagatgaggctgactactactgcagctcatatgcaggcactaacaattttgtcttcggaagtgggaccaaggtcaccgtcctaa

SEQ ID NO: 8316 - DNA, 325 bp, Artificial Sequence
  Synthetic construct
gagattgtgttgacgcagtcgccaggcaccctgtcggtgactccaggacaaaaagccagcgtctcctgcagggccagtcagactattaactacaactatatagcctggtatcagcagaaagctggccagagtcccaggctcctcatctctgggacttccaatagggccgctggcgttcccgacagattcagtggcagtgggtctggagcagagttcactctcaccatcaccagactggagcctgaagattttgcagtctatttctgtcaacaatatggtaattcacctcagacgttcggccaagggaccaaggtggaaatcaaac

SEQ ID NO: 8317 - DNA, 322 bp, Artificial Sequence
  Synthetic construct
gacatccagatgacccagtctccatcctccctgtcagcatctgtaggcgacagagtcaccatcacttgccgggcgagtcagtccattggcaattttttggcctggtatcagcagaaaccagggacagcccctaaactcctggtctctgctgcgtccactttggggagtggggtcccatccaggtttagtggcagtggttctggggcggattacattctcaccatcaccaccctgcaacctgaggatttcgcttcttattactgtcaccagtattatgcgaccccatacacctttggccaggggaccaggctggagatcaaac

SEQ ID NO: 8318 - DNA, 322 bp, Artificial Sequence
  Synthetic construct
gacatccagatgacccagtctccatcctccctgtctgcatctgtcggagacagaatcaccatcacttgccgggcaagtcagacctttaacggctttttaaattggtttcagcagaaaccggggagcgcccctaaactcctcatctatactgcatccactttgcaaagtggggtcccaacaaggttcagtggcagtggatctgggacagagttcactctcaccatcagcagtctgcaacctgaagattttgcaacttactactgtcaacagagtttcagacccccgctcactttcggcggagggaccagggtggagatgaaac

SEQ ID NO: 8319 - DNA, 325 bp, Artificial Sequence
  Synthetic construct
gaaattgtgttgacacagtctccagccaccctgtctttgtctccaggggacagagccaccctctcctgcagggccagtcagagtgttagcagctacttagcctggtaccaacagaagcctggccaggctcccaggctcctcatctatgatgcatccgacagggccactggcatcccagccaggttcagtggcagtgggtctgggacagacttcactctcaccatcagcagcctagagcctgaagattttgcagtttattactgtcagcagcgtagcagctggcctccgatcaccttcggccaagggacacgactggagattaaac

SEQ ID NO: 8320 - DNA, 325 bp, Artificial Sequence
  Synthetic construct
ccctatgtgctgactcaaccaccctcactgtcagtggccccagggaagacggccaggatttcctgtgggggagacaaacttggccgcagaagtgttcactggtaccagttgaggccaggccaggcccctgtgttggtcatccatgatgatgacgtccggcccccagagatccctgagcgattctctggctccaattctgggaacacggccaccctgaccatcaacagggtcaaagccggggatgaggccgactatttttgtcaggtgtgggatagtagtgttgatcccgtgatattcggcggagggaccaagctcaccgtcctgg

SEQ ID NO: 8321 - DNA, 331 bp, Artificial Sequence
  Synthetic construct
ctatctgtgttgacgcagccgccctcagtgtctgcggccccaggacagaaggtctccatctcctgctctggaagcacctccaacattgggaataattatgtgtcctggtaccagcatgtcccaggagcagcccccaaactcctcatttatgacaacaataagcgaccctcagggattcctgaccgattctctggctccaagtctggcacgtcagccaccctggacatcaccgaaatcctgactggggaccaggccgattattactgcggaacatgggatgctagcgtgagtgttgcggtattcggcggagggaccaagctgaccgtcctcg

SEQ ID NO: 8322 - DNA, 331 bp, Artificial Sequence
  Synthetic construct
cagtctgtgttgacgcagccgccctccgtgtctgcggccccaggacagaatgtcaccatctcctgctctggaagcagctccaatattgggaataattatgtttcctggcaccagcagttcccaggaacagcccccaaaatcctcatttatgacactactaagcgaccctcagggattcctgaccgattctctggcgccaagtcaggcacgtcagccaccttggacatcaccggactccagactggggacgaggccgattattactgcggagcatgggatagcagcctgaatgttgtggtgttcggcggggggaccaagctgaccgtcctag

SEQ ID NO: 8323 - DNA, 340 bp, Artificial Sequence
  Synthetic construct
gacatcgtgatgacccagtctccagactccctggctgtgtctctgggcgagcgggccaccatcaactgcaagtccagccagaatcttttatccagcttcaacagtgaaaactacttagcttggtaccaacagaagccaggacagcccccaaagttgctcatttactgggcatctacccgggaatccggggtccctgaccgaatcagtggcaccgggtctgggacagatttcactctcaccatcagtgatctacaggctgcagatgtggcagtttattactgtcaacaatattataatattccttggacgttcggccaagggaccaagctggaaatcaaaa

SEQ ID NO: 8324 - DNA, 331 bp, Artificial Sequence
  Synthetic construct
cagtctgtcctgactcagccgccctcagcgtctgggacccccgggctgagggtcaccgtctcttgttctggaagcagctccaacatcggaagtaatactgttaactggtaccagcacctcccaggagcgccccccaaactcctcatctataatgataataagaggccctcaggactccctgaccgattctctggctccaagtctggcacctcagcctccctggccatcagtgggctccagtctgaggatgaggctgattattactgtgcagcatgggatggcagcctgaatggttatgtcttcggacctgggaccaaggtcaccgtcctag

SEQ ID NO: 8325 - DNA, 328 bp, Artificial Sequence
  Synthetic construct
gacatccagatgacccagtctccatcctccctgtctgtgtctctaggagaaagagtcaccatcacttgccaggcgagtcaagacataggtaactttttaaattggtatcagcagaaaccagggaaagcccctaaactcctgatctacgatggatccaatttggaaacaggggtcccatcaaggttcagtggacgtggctctgggacactttttacattcaccatcagtagcctgcaggctgaagatattgcaacatattactgtcaacaatatgagaacatccctccggggctcacgttcggcggagggaccacggtggagatcaaac

SEQ ID NO: 8326 - DNA, 334 bp, Artificial Sequence
  Synthetic construct
cagtctgccctgactcagcctccctccgcgtccgggtctcttggacagtcagtcaccatctcctgcagtggagccagtagtgacagtagtgtttataactctgtctcctggtaccaacagcgcccagggaaagccccccaactcatcatttatgaagtctataagcgaccctcagggatccctgatcgcttctctggctcccagtctggcaacacggcctccctgaccgtctctgggctccaggctgaggatgaggctgattatttctgcagctcatatgaaaccagcaacaatttgaggttattcggcggagggaccaagctgaccgtcctag

SEQ ID NO: 8327 - DNA, 325 bp, Artificial Sequence
  Synthetic construct
gaaattgtggtgacgcaatctccaggcaccctgtctttgtctccaggggagagagccaccctctcctgcagggccagtcagagtgtaagcggcaaccacttagcctggtaccagcagaagcctggccaggctcccaggctcctcatctacgctgcatccagcagggccactggcatcccagacaggttcagtggcagtgggtctgggacagacttcactctcaccatcagcagactggagcctgaagattttgcagtctatttctgtcagcagtatggtagctcacctgggacgttcggccaagggaccaaggtggaaatcaaac

SEQ ID NO: 8328 - DNA, 325 bp, Artificial Sequence
  Synthetic construct
gaaactgtgttaacgcagtctccagacaccctgtctttgactccaggggaaagagccaccctctcctgcaggcccagtcagagtattagcgatttctacttagcctggtaccagcagaaacctggccaggctcccaggctcctcatctatggtgcctccagcagggccactggcatccccgacaggttcagtggcagtgggtctgggacagacttcactctcaccatcagcagactggagcctgaagattctgcagtatattactgtcagcagtatggcatctcaccgtacacttttggcccggggaccaaggttgagatcaaac

SEQ ID NO: 8329 - DNA, 325 bp, Artificial Sequence
  Synthetic construct
tcctatgtgctgactcaggcaccctcggtgtcagtggccccaggacagacggccaggattacctgtgggggaaacaacattggaagtaaaagtgtgaactggtaccagcagaagccaggccaggcccctgcgctggtcgtctatgatgatagcgaccggccctcagggatccctgagcgattctctggctccaactctgggaacacggccaccctgaccatcaccagggtcgaagccggggatgaggccgactattcctgtcaggtgtgggatagtagtagtgatcattatgtcttcggaactgggaccaaggtcaccgtcctag

SEQ ID NO: 8330 - DNA, 340 bp, Artificial Sequence
  Synthetic construct
gagattgtggtgacccagactccactctccttgtctatcacccctggagagcaggcctccatgtcctgcaggtctagtcagagcctcctgcatagtgatggatacacctatttgtattggtttctgcagaaagccaggccagtctccacgctcctgatctatgaagtttccaaccggttctctggggtgccagataggttcagtggcagcgggtcagggacagatttcacactgaaaatcagccgggtggaggctgaggatgttggagtttattactgcatgcaagatgcacaagatcccttgttcactttcggccctgggaccaaagtggatatcaaac

SEQ ID NO: 8331 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccactggcatcccagacaggttcagtggcagtgggtctgggacagacttcactctcaccatcagcaggctggagcctgaagattttgcagtgtattactgtcagcagtctggtagctcaccgtacacttttggccaggggaccaagctggagatcaaac

SEQ ID NO: 8332 - DNA, 340 bp, Artificial Sequence
  Synthetic construct
gacatcgttgtgacccagtctccagcctccctggctgtgtctctgggcgagagggccaccatcaactgcaagtccactgaaagtcttttatacagttcaaccaatcgtgactacttggcttggtaccagcacaaaccggggcagcctcctaaactgctcctttacggggcatcgaccccggcatccggagtccctggccgattcaacggcagcggctccgggacagatttcactctcaccatcaccagtctgcaggctgaagatgtgggcgtctattactgtcaacaatattttcgtactcctccgactttcggccaagggaccaaggtggaaatgaaac

SEQ ID NO: 8333 - DNA, 319 bp, Artificial Sequence
  Synthetic construct
gacatccagatgacccagtctccatcctccctgtctgcatctgttggagacagagtcaccatcacttgccgggcaagtcagaccattaataactatttgaattggtatcagcagaaaccagggaaagcccctaaactcctgatctatggtgttaccactttgcagagtggggtcccatcaaggttcagtggcagtgggtctggggcagatttcactctcaccatcagcagtctgcaacctgaagattttgcgacttactactgtcaacagagttacacttccctcactttcggcggagggaccacggtggaaatcaaac

SEQ ID NO: 8334 - DNA, 322 bp, Artificial Sequence
  Synthetic construct
gccatccagttgacccagtctccattctccctgtctgcatctgttggagacagagtcaccatcgcttgccgggccagtcagggcattagcgattacttagcctggtatcagcagaaaccagggaaagcccctaaactcctgatctatgctgcatccactttgcaacgtggggtcccatcaaggttcagcgccagtggatctgggacagatttcactctctccatcagcagcctgcagcctgaagattttgcaacttattactgtcaacaggttgatgctgacccgatcaccttcggccaagggacacgactggagattaaac

SEQ ID NO: 8335 - DNA, 331 bp, Artificial Sequence
  Synthetic construct
cagtctgtcttgactcagccaccctcagtgtctgggacccccgggcagagggtcaccatgtcttgttctggaagcagctcaaacatcggaagaaaccctgtaaactggtatcagcaagtcccaggatcggcccccaaagtcctcatgtatagggattctcaacggcccacaggggtccccgaccgattcctcggctccaactctggcacctcagcctccctggccatcagtgacctccagactgacgatgaggctgattattactgtgcagtttgggatgacaacctgagggcttgggtgttcggcggatggaccaagttgaccgtcctag

SEQ ID NO: 8336 - DNA, 331 bp, Artificial Sequence
  Synthetic construct
cagtctgtggtgacggagccgccctcagtgtctgcggccccaggacagaaggtcaccatctcctgctctggaagcagctccaacattgggatttatcctgtatcctggtaccagcagctcccaggaacagcccccaaactcctcatttttgacaatgataaacgaccctcagggattcctgaccgattctctggctccaagtctggcacgtcagccaccctggacatcaccggactccagactggggacgaggccgactattactgcggaacatgggatagcagtttgagtggtggggtgttcggcggagggaccaagctgaccgtcctag

SEQ ID NO: 8337 - DNA, 334 bp, Artificial Sequence
  Synthetic construct
cagtctgccctgactcagcctgcctccgtgtctgggtctcctggacagtcgatcaccatctcctgcattggaaccggcagtgacgttggtggttatgactatgtctcttggtaccaacaacacccaggcaaagcccccaaactcataatttacgatgtcagtaatcggccctcaggagtctctcatcgcttctctggctccaagtctggctacacggcctccctgatcatctcggggctccaggctgaggacgaggctgattatttctgcgcctcatataccgttagtagtagtctcgaggtcttcgggacagggaccaaggtcaccgtcctag

SEQ ID NO: 8338 - DNA, 322 bp, Artificial Sequence
  Synthetic construct
gacatcgagatgacccagtctccatcttccatgtctgcatctgtaggagacagcgtcaccatcacttgtcgggcgagccagggccttagtggtgaattagcctggtatcggcagagaccaggggaagcccccaaactcctgatttatgatgcatcaaggttggaaagtggagtcccgtcaacgttcagcggcggtggatctgggacagttttcattctcttcatcagcagtatgcagcctgaagattttggaacttactattgtcaacaagcaaacagtttccctcacacgttcggccaagggaccaaggtggaaatgaaac

SEQ ID NO: 8339 - DNA, 331 bp, Artificial Sequence
  Synthetic construct
cagtctgtggtgactcagccaccctcagcgtctgggacccccgggcagagggtcaccttctcttgttctggaagcagctccaacatcggacgaaattatgtatactggtatcagcagctcccaggaacggcccccaaactcctcgtctataggaatgatcagcggctctcaggggtccctgaccgattctctggctccaagtctggcacctcagcctccctggccatcagtgggctccggtccgaggatgaggctgattattactgtgcagcatgggatgacagcctgagtggtccggtattcggcggagggaccaagctgaccgtcctag

SEQ ID NO: 8340 - DNA, 337 bp, Artificial Sequence
  Synthetic construct
gatattgtgatgacccaggctccactctctctgtccgtcacccctggacaggcggcctccatctcctgcaagtccagtcagagcctcctccatagtaatggaaagacctatttatattggtacgtgcagaagccaggccagtcaccacagctcctgatctacgaggtttccaatcggttctctggagtgccagataggttcagtggcagcgggtcagggacagatttcacactgaaaatcagccgggcggaggctgaggatgtcgggatctattactgcatgcaaaataaacaggtttccataaccttcggccaagggacacgactggagattaaac

SEQ ID NO: 8341 - DNA, 331 bp, Artificial Sequence
  Synthetic construct
cagtctgtgttgacgcagtcgccctcagtgtctgcggccccaggacagaaggtcaccatctcctgctctggaggcagctccaacattgggcataattatgtatcctggtaccagcagatcccaggaacagcccccaaactcctcatctatgaaaataataagcgaccctcagggattcctgaccgattctctggctccaagtctggcacgtcagccaccctgggcatcaccggactccagactggggacgaggccgcttattactgcggaacatgggataacagcctgagtgcttgggtgttcggcggagggaccaaactgaccgtcctag

SEQ ID NO: 8342 - DNA, 331 bp, Artificial Sequence
  Synthetic construct
cagtctgtgctgactcagccaccctcagcgtctgggacccccgggcagagggtcaccatctcttgttctggaaggagctccaacatcggaagtaatactataaactggtaccagcagctcccaggaacggcccccaaactcctcatctatactaataatcaggggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctag

SEQ ID NO: 8343 - DNA, 325 bp, Artificial Sequence
  Synthetic construct
gaaactgtgttgacgcagtctccaggcaccctgtctttgtctccaggggaaagagccgccctctcctgcagggccagtcagagtgttagcagcgaccacttagcctggtaccagcacaaacctggccaggctcccaggctcctcatctatggtgcatccagcagggccactggcatcccagacaggttcagtggaagtgggtctgggacagacttcactctaatcatcaccacagtagagcccgaagattttgccgtgtattattgtcaccagtatgataagtctccctacactttcggccctgggaccaaactggaaatcagcc

SEQ ID NO: 8344 - DNA, 325 bp, Artificial Sequence
  Synthetic construct
gaaacgacactcacgcagtccccagcattcatgtcagcgactccaggagacaaagtcaacatctcctgcaaagccacccaagacattgatgatgatgtgaactggtacctacagaaaccaggagaagctactcttttcattactcaagaagttactactctcgttcctggaatcccacctcgattcagtggcagcgggtctggaacagattttaccctcacaattgataacatagaatctgaggattctccttattacttctgcctacaacatgataatttccctctcggctcttttggccaggggaccaagctggagatcaaac

SEQ ID NO: 8345 - DNA, 325 bp, Artificial Sequence
  Synthetic construct
gacatccagatgacccagtctccctcctccctgtctgcatctgtaggagacagagtcaccatcacttgccgggcaagtcagagcattagcagctatttaaattggtttcagcagaaaccagggaaagcccctaagctcctgatctatgctgcatccagtttgcaaagtggggtcccatcaaggttcagtggcagtggatctgggacatatttcactctcaccatcaacagtctgcaacctgaagattttgcagcttactactgtcaacagagtcacagttcctctccgtggacgttcggccaagggaccaaggtggaaatcaaac

SEQ ID NO: 8346 - DNA, 337 bp, Artificial Sequence
  Synthetic construct
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgtggacgttcggccaagggaccaaggtggaaatcaaac

SEQ ID NO: 8347 - DNA, 334 bp, Artificial Sequence
  Synthetic construct
cagtctgtgctgacgcagccgccctcagtgtctggggccccagggcagagggtcaccatctcctgcactgggagcagctccaacatcggggcaaattatgatgtacactggtaccagcaacttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttgggtgttcggcggagggaccaagttgaccgtcctag

SEQ ID NO: 8348 - DNA, 322 bp, Artificial Sequence
  Synthetic construct
gacatccagatgacccagtctccatcctccctgtctgcatctgttggagacagtgtcaccgtcacttgccgggcgagtcaggtcattaccaattctttagcctggtatcagcagaaaccagggaacgcccctaaactcctggtctctgctgcatccaaattggaaagtggggtccctcccaggttcagtggcagtggatctggggcgcagtacactctcaccatcaccagcctgcagcctgaagattttgcaacttattactgtcaacaatattatgatacccctcggacgttcggccaagggaccaaagtggaattcaaac

SEQ ID NO: 8349 - DNA, 334 bp, Artificial Sequence
  Synthetic construct
cagtctgccttgactcagactgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 8350 - DNA, 322 bp, Artificial Sequence
  Synthetic construct
gacatccggatgacccagtctccatcctccctgtctgcatctgtgggagacacagtcaccatcacttgccgggcaagtcagagcattagaaatgatttaacctggcttcagcagagaccagggcaagcccctaagcgcctcatcttttctgcttcctctttacattcgggggtcccatcgagattcagcggcagtgggtctggggcagagttcactctcacaatcaacggcctacagcctgaagattttgcaacttactactgtcttcagcacaatggttaccctcggtcgttcggccaagggaccaaagttgattttaaac

SEQ ID NO: 8351 - DNA, 325 bp, Artificial Sequence
  Synthetic construct
tcctatgaggtgacacagccaccctcggtgtcagtgtccccaggacagacggccaagatcacctgctctggagatacattgtcaaagcaatatactcattggtaccagcagaagccaggccaggcccctgtgttggtaatatgtaaagacactgagaggccctcagggattcctgaacgattctctggctccagctcagggacaacagtcaccttgaccatcactggagtccaggcagaagacgaggctgactattattgtcagtcactagacagtagtggtgtttatgtggtattcggcggagggaccaagctgaccgtcctgg

SEQ ID NO: 8352 - DNA, 322 bp, Artificial Sequence
  Synthetic construct
gacatccagatgacgcagtctccagcctccctgtctgcatctgttggcgacagggtcaccctcacctgccaggcgagtcaggaaatagaacatcatttaaattggtatcaagtgaagcctgggaaaggccctaaattcctgatgtccgaggcatccattttggaaacaggggtctcttcaaggttcagtggcagtggatctgggacaaatttttccttcaccatcaacaactttcagcccgaggacgtggcaacatatgtctgtcaacagtattttgatctccgtttcggtttcggccctggaaccaaggttgatctcaagc

SEQ ID NO: 8353 - DNA, 328 bp, Artificial Sequence
  Synthetic construct
cagtctgccctgactcagcctgcctccgtgtctgggtctcctggacagtcgatcaccatctcctgcactggaaccagcagtgacgttggtggttataactttgtctcctggtaccaacaacacccaggcaaagcccccaaagtcatgatttatgatgtcagtaatcggccctcaggggtttctaatcgcttctctggctccaagtctggcaacacggcctccctgaccatctctgggctccaggctgaggacgaggctgattattactgcagctcgtatacaagcaacattattttatttggcggggggaccaagctgaccgtcctag

SEQ ID NO: 8354 - DNA, 322 bp, Artificial Sequence
  Synthetic construct
gacatccagatgacccagtctccatcttccgtgtctgcatctgtaggagacagagtcaccatcacttgtcgggcgagtcagggtattagcagctttctagcctggtatcagcagaaaccagggaaagcccctaaactcctgatcgctgctgcatcgagtttgcaaaggggggtcccgtcaaggttcagcggcagtggatctgggacagatttcactctcaccatcagcagcctgcagcctgaagattttgcgacttactattgtcagcagactaccagtttccctctcactttcggcggagggaccaatgtagagatcaaac

SEQ ID NO: 8355 - DNA, 340 bp, Artificial Sequence
  Synthetic construct
gacatcgtgatgacccagtctccagactccctggctgtgtctctgggcgagagggccaccatcaactgcaagtccagccagagtattttaaacagtgccagcaataaggaccacctagcttggtaccaacagaaagcaggacagcctcctaagctgctcttcttctgggcttctacccgagagtccggggtcccggaccgattcagtgccagcgggtctgggagtgatttcactttgaccatcagcagcctgcaggctgaggatgtggctgtttattattgtcagcactttaacggttctcctctcactttcggcggagggaccagggtggagatcaatc

SEQ ID NO: 8356 - DNA, 328 bp, Artificial Sequence
  Synthetic construct
tcctatgtgctgactcagccaccctcggtgtcagtggccccaggacagacggccaggattacctgtgggggagacaacattgtgagtaaaagtgtgcactggtaccagcagaagccaggccaggcccctgtgctggtcgtctatgatgatagcgaccggccctcagggatccctgagcgattctctggcgccaactctgggaacacggccaccctgaccatcagcacggtcgaagccggggatgaggccgactatcactgtcaggtgtgggacagtagtagtgatcacccctatgtcttcggaactgggaccaaggtcaccgtcctag

SEQ ID NO: 8357 - DNA, 322 bp, Artificial Sequence
  Synthetic construct
gccatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttacccgctcactttcggcggagggaccaaggtggagatcaaac

SEQ ID NO: 8358 - DNA, 331 bp, Artificial Sequence
  Synthetic construct
cagtctgccctgactcagcctgcctccgtgtctgggtcgccgggacagtcgatcaccatctcctgcactggaaccagcagtgacgttggtgcttatagttttgtctcctggtttcaacaacacccaggcagagcccccaaactcatgatttatggggtcactaatcggccctcaggggtttcttatcgcttctctggctccaagtctggcaacacggcctccctgaccatctctggcctccaggctgaggacgaggctgattatttctgcaactcatatacaagcagcagcacttatgtcttcggaactgggaccaaggtcaccgtcctag

SEQ ID NO: 8359 - DNA, 322 bp, Artificial Sequence
  Synthetic construct
gatgtagtgatgacacagtctccagccaccctgtctgtgtctccaggggaatcagccaccctctcctgcagggccagtcagagtgtaagcagcaatttagcctggtaccagcagaaacctggccaggctcccaggctcctcttctatggtgcatctaccagggccactggtatcccagccaggttcagtggtagtggatttgggacagagttcactctcaccatcttcaacgtgcagtctgaagattgtgcagtttattactgtcaacactataatgactggcaaatcactttcggcggagggaccaagatgcagatcaaac

SEQ ID NO: 8360 - DNA, 322 bp, Artificial Sequence
  Synthetic construct
gacatccagatgacccagtctccatcctccctgtctgcgtctgtaggagacagagtcaccatcacttgccgggcaagtcagagcattagcttctatttaaattggtatcagcagaaaccagggaaagcccctcagctcctgatctatgctacatccagttttcatggtggggtccctgcaaggttcactggcagtggatctgggacagatttcactctcactatcaacactctgcaacctgaagattttgcaacttactactgcgaacagacctatagtattccgtggactttcggccaagggaccaaggtggaaatcaaac

SEQ ID NO: 8361 - DNA, 322 bp, Artificial Sequence
  Synthetic construct
caaattgtgttgacacagtctccagccaccctgtctttgtctccaggggaaagagccaccctctcctgcagggccagtcagggtgttggcagctacttagcctggtaccaacagagacctggccaggctcccaggctcctcatctatgatgcatccaacaggcccactggcatcccaggcaggttcagtgccagtgggtctgggacagacttcactctcaccatcagcagcctagagcctgaagattttgcagtttattactgtcagcagcgtttcaagtggcccatcaccttcgcccaagggacacgactggagattaaac

SEQ ID NO: 8362 - DNA, 334 bp, Artificial Sequence
  Synthetic construct
cagtctgttctgacgcagccgccctcagtgtctggggccccaggacagagggtcaccatctcctgcactgggagtagttccaacatcgggggcaatcatgatgtacattggtaccagcaccttccagggacagcccccaaactcctcatctatggtaacaacaatcggccctcaggggtccctgaccgattctctggctccaagtctgccacctcagcctccctggccatcactgggctccaggctgaggatgaggctgattattactgccagtcctttgacgacagcctgaatgcttcgctgttcggcggtgggaccaagctgaccgtcctag

SEQ ID NO: 8363 - DNA, 334 bp, Artificial Sequence
  Synthetic construct
cagtctgccctgactcagcctgcctccgtgtctgggtctcctggacagtcgatcaccatctcctgcactggaaccagcactgacgttggtggttataactatgtctcctggtaccaacaaaacccaggcaaagcccccaaactcatgatttatgatgtcagtgatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaagctgaccgtcctag

SEQ ID NO: 8364 - DNA, 325 bp, Artificial Sequence
  Synthetic construct
tcttctgagctgactcaggaccctgctatgtctgtggccgtgggacagcaagtcaccatcacatgccacggagacagcctccgagaacatgctgccaattggtaccagcagaagtcaggacaggccccgaaacttgtcatttatggtaaaaggaatcggccctcagggatcccagaccgattcattggctccgcctcaggaagcacagcttacttgatcatcaataacattgaggcggacgatgaggctgactattattgtaactgccgagacaccagtggtgacccttgggtgttcggcagagggaccaagttgaccgtcctgc

SEQ ID NO: 8365 - DNA, 162 bp, Artificial Sequence
  Synthetic construct
gagggatcccagaccgattcattggctccgcctcaggaagcacagcttacttgatcatcaataacattgaggcggacgatgaggctgactattattgtaactgccgagacaccagtggtgacccttgggtgttcggcagagggaccaagttgaccgtcctgc

SEQ ID NO: 8366 - DNA, 325 bp, Artificial Sequence
  Synthetic construct
gaaattgtgttgacacagtctccagccaccctgtctttgtctccaggggaaagagccaccctctcctgcagggccagtcacagtattagcagctacttagcctggtaccaacagaaacctggccagtctcccaggctcctcatctatgatgcatccaacagggccactggcatcccagccaggttcggtggcagtgggtctgggacagacttcactctcaccatcagcagcctagagcctggagactttgcagtttattactgtcagcagcgtagcaactggccctcggtcactttcggccctgggaccaaagtggatatcaaac

SEQ ID NO: 8367 - DNA, 337 bp, Artificial Sequence
  Synthetic construct
gatattgtgatgacccagactccactctcctcacctgtcacccttggacagccggcctccatctcctgcaggtctagtcaaggcctcgtacacagtgatggaaacacctacttgacttggcttcagcagaggccaggccagcctccaagactcctcatttatatgatttctaaccggttctctggggtcccagacagattcagtggcagtggggcagggacagatttcacactgaaaatcagcagggtggaagctgaggatgtcggggtttattactgcacgcaagctacacaattcccctacacttttggccaggggaccaagctggagatcaaac

SEQ ID NO: 8368 - DNA, 322 bp, Artificial Sequence
  Synthetic construct
gacatccagatgacccagtctccctcttccgtgtctgcatctgttggagacagagtcaccatcacttgtcgggcgagtcagggtattagcagttggttagcctggtatcaacagaagccagggaaagcccctaaactcctgatatatgctacatccagtttgcagggtggggtcccatcgaggttcagcggcggtggatctgggacagaattcactctcaccatcagcagcctgcagcctgaagattccgcaatttactattgtcaacaggctaacagtttacctctcactttcggcggcgggaccaaggtggagatcaatc

SEQ ID NO: 8369 - DNA, 322 bp, Artificial Sequence
  Synthetic construct
gaaattgtgctgactcagtctccagactttcagtctgtgactccaaaggagaaagtcaccatcacctgccgggccagtcagagcattggtaatagcttacactggtaccagcaaaaatcaaatcagtctccacagctcctcatcaagtatgcttcccagtccatctcaggggtcccctcgaggttcagtggcagtggatctgggacagatttcaccctcagcatcaatagcctggaagctgaagatgctgcaacgtattactgtcatcaaagtagtagtttaccgtacacttttggccaggggaccaagctggagatcaaac

SEQ ID NO: 8370 - DNA, 325 bp, Artificial Sequence
  Synthetic construct
gaaattgtgttgacgcagtctccaggcaccctgtctttgtctccaggggaaagagccaccctctcctgcagggccagtcagagtgttaacagtaactacttagcctggtaccagcacaaacctggccaggctcccaggctcctcatctatgctgcatccagcagggccactggcatcccagacaggttcagtggcagtgggtctgggacagacttcactctcaccatcaacagactggagcctgaagattttgcattttattactgtcagcagtatggtagttcacctcggacgttcggtcaagggaccaaggtggaaatcaaac

SEQ ID NO: 8371 - DNA, 310 bp, Artificial Sequence
  Synthetic construct
gacatccagatgacccagtctccatcctccctgtctgcatctgtgggagacagagtcaccatcacttgccgggcaagtcagtccattaactactatttaaattggtatcaaaagaagccagggacagcccctaagctcctgatctatgctgcaagtattttgcaaaatggggtcccctcaaggttcagtggcagtgggtctgggacagatttctctctcaccatcagcagtctccaacctgaagattttgcaacttactactgtcaacagagtggcactttcggcggagggaccaaggtggagttcaagc

SEQ ID NO: 8372 - DNA, 319 bp, Artificial Sequence
  Synthetic construct
gacatccagatgacccagtctccttccatcctgtctgcatctgtaggagacagagtcaccatcacttgccgggccagtcagagtattagtagctggttggcctggtatcagcagaaaccagggaaagcccctaaactcctgatctatagggcgtctggtttagaaactggagtcccatccaggttcagcggcagtggatctgggaccgaattcactctcaccatcaacagcctgcagcctgatgattttgcaacttattactgccaacagtatcattcttattcgacgttcggccaagggaccaaggtggagatcaaag

SEQ ID NO: 8373 - DNA, 328 bp, Artificial Sequence
  Synthetic construct
gaaatagtgatgacgcagtctccagccaccctgtctgtgtctccaggggaaagagtcaccctctcctgcagggccagtcagagtgttagcagcaacttagcctggtaccagcagaaacctggccaggctcccaggctcctcatctatggtgcttccacgagggccactggtatcccagccaggttcagtggcagtgggtctgggacagagttcactctcaccatcagcagcctgcagtctgaagattttgcagtttattactgtcaggagtataatagctggcctccggagtacgcttttggccaggggaccagcctggagatcaaaa

SEQ ID NO: 8374 - DNA, 331 bp, Artificial Sequence
  Synthetic construct
gaaattgtgttgacgcagtctccaggcaccttgtctttgtctccaggggacagagccaccctctcctgcagggccagtcagactgttagcaacacctccttagcctggtaccagcagaaacctggccaggctcccagactcctcatctatggtgcatccaggagggccattgacatcccagacaggttcaggggcactgggtctgggacagacttcactctcaccatcagcagactgcaacctgaagattttgcagtgtatttctgtcagcagtatggtagctcacctccgatgtacacctttggccaggggaccaaactggagatcaaag

SEQ ID NO: 8375 - DNA, 322 bp, Artificial Sequence
  Synthetic construct
gacatccagatgacccagtctccagcctccctgtctgcatctgtgggagacagagtaaccatcacttgccgggcgagtcaggccataagcaattccttagcctggtatcaacagagaccagggaaagcccctaaactcctcctctatgttgcatccagattggagagtggggtcccatccaggttcagcggcagtggatctgggacggattacactctcaccatcagcaccctgcagcctgaagattttgcaacttatttctgtcaacagttttttcgaaccccgtacacttttggccaggggaccaagctggaaatcaagc

SEQ ID NO: 8376 - DNA, 334 bp, Artificial Sequence
  Synthetic construct
cagtctgccctgactcagcctgcctccgtgtctgggtctcctggacagtcgatcaccatctcctgcactggaaccagcagtgacgttggtgattataactatgtctcctggtaccaacaaaacccaggcaaagcccccaaagtcttgatttatgagggcagtaagcggccctcaggggtttctaatcgcttctctggctccaagtctggcaacacggcctccctgaccatctctgggctccaggctgacgacgaggctgattattactgcacctcatatacaaacaacagcaattctcaggtattcggcggagggaccaaggtgaccgtcctag

SEQ ID NO: 8377 - DNA, 343 bp, Artificial Sequence
  Synthetic construct
cagcctgtcctgactcagccaccttcctcctccgcatctcctggagaatccgccagactcacctgcaccttgcccagtgacatcaatgttggtagccacaacatattttggtatcagcagaagccagggagccctcccaggtatctcctatattactactcagactcagataagggccagggctctggagtccccagccgcttctctgcgtccaaagatgcttcagccaatacagggattttactcatctccgggctccagtctgaggatgaggctgactattactgtatgatttggtcagacgcgtatgtcttcggaactgggaccaaggtcaccgtcctcc

SEQ ID NO: 8378 - DNA, 322 bp, Artificial Sequence
  Synthetic construct
gacatccagatgacccagtctccatcctccctgtctgcgtctgtaggagacagagtcagcatcacttgccaggcgagtcaggacattaccaaatatttaaattggtatcagtggaaaccagggaaagcccctaaggtcctgatttacgatgcatccaatttggaaacaggggtcccatcaaggttcagtggaggtggttctgggacacattttactttcaacataagcagcctgcagcctgaagatattggaacatattactgtcaacagtatgatgatcttccgctcactttcggcggagggaccaaggtggagatcaagc

SEQ ID NO: 8379 - DNA, 210 bp, Artificial Sequence
  Synthetic construct
caggcaaagcccccaaagtcttgatttatgagggcagtaagcggccctcaggggtttctaatcgcttctctggctccaagtctggcaacacggcctccctgacaatctctgggctccaggctgacgacgaggctgattattactgcacctcatatacaaacaacagcaattctcaggtattcggcggagggaccaagctgaccgtcctag

SEQ ID NO: 8380 - DNA, 322 bp, Artificial Sequence
  Synthetic construct
gacattcagatgacccagtctccatcttccgtgtctgcatctgtaggagacagggtcaccatctcttgtcgggcgagtcagggtgctcacaaatggttagcctggtatcagcagaaagcagggaaggccccaaagctcctgatctatgctgcatccactttacaagttggggtcccatccaggttcagcggcgatggatttgggacagatttcacgctcaccatcagcagcctgcagcctgaagattccgcaacttactattgtcaacaggctgacaatttgccgtggacgttcggccaagggaccagggtggacgtcagac

SEQ ID NO: 8381 - DNA, 328 bp, Artificial Sequence
  Synthetic construct
gaaattgtgttgacacagtctccagtcaccctgtctttgtctccaggggaaagagccaccctctcctgcagggccagtcagagtgtcagaaactccttagcctggtaccagtacaaatctggccaggctcccaaactcctcatctttgatgcgtccaacagggccactggcatccccgccaggttcagtggcagtgggtttgggacagacttcactctcaccatcagcagcctagagcctgacgattttgctgtttattactgtcagcagcgtagcgactggcctccggtgtacacttttggccaggggaccaagctggagatcacgc

SEQ ID NO: 8382 - DNA, 331 bp, Artificial Sequence
  Synthetic construct
cagtctgtgttgacgcagccgccctcagtgtctgcggccccaggacaggaggtcaccatctcctgctctggaaacatctccaacattgggagaaattatgtctcctggtatcagcagttcccaggagcagcccccgaactcctcctttttgacaataataagcgctccccagggactcctgaccgaatccatggcttccggtctggcacgtcagccagagtggccatcaccgacctccaaactggggacgaggccgactattactgcgccgcttgggacgaccacctgcgaattgtgggtttcggcggggggaccaagctgaccgtcctgg

SEQ ID NO: 8383 - DNA, 286 bp, Artificial Sequence
  Synthetic construct
cagtctgccctgactcagcctgcctccgtgtccgggtttggtggttataactatgtctcctggtaccaacaaaacccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtattcggcggagggaccaagctgaccgtcctag

SEQ ID NO: 8384 - DNA, 325 bp, Artificial Sequence
  Synthetic construct
tcctatgtgctgactcagccaccctcagtgtcagtggccccaggaaagacggccaggattacctgtggaggaaacaacattggaagtaaaagtgtgcagtggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattattgtcaggtgtgggatagtagtagtgatccccgggtgttcggcggagggaccaacctgaccgtcctag

SEQ ID NO: 8385 - DNA, 340 bp, Artificial Sequence
  Synthetic construct
gacatcgtgatgacccagtctccagactccctggctgtgtctctgggcgagagggccaccatcaactgcaagtccagccagagtgttttatacagctcctacaataagagctacttaggttggtaccagcagaaaccaggacagcctcctaagttgctcctttactgggcatctatccgggaatccggggtccctgaccgattcagtggcagcgggtctgggacagatttcactctcaccatcagcagcctgcaggctgaagatgtggcaatttattactgtcagcaatattatagtactccgtggacgttcggccaagggaccaaggtggaaatcaaac

SEQ ID NO: 8386 - DNA, 331 bp, Artificial Sequence
  Synthetic construct
cagtctgtgctgactcagccaccctcagcgtctgggacccccgggcagagggtcaccgtctcttgctctggaagcagctccaacatcggaagtaatactgtaaattggtaccagcagctcccaggaacggcccccaaactcctcatttataggaataatcagcggccctcaggggtccctgaccgattctctggctccaagtctggcatctcagcctccctggccatcagtgggctccaggctgaggatgaggctgattattactgtgcagcatgggatgacagcctgaatggtcccgtcttcggcggagggaccaaggtgaccgtccttg

SEQ ID NO: 8387 - DNA, 334 bp, Artificial Sequence
  Synthetic construct
cagtctgtgctgacgcagccgccctcagtgtccggggccgcagggcagagggtcaccatctcctgcactgggagcagctccaacatcggggcaggttatgatatacactggtaccaggaccttccaggaacagcccccaaactcctcatctatggcaacaacaatcggccctcaggggtccctgaccgattctctggctccaagtctggcacctcagcctccctggccatcactgggctccaggctgaggatgaggctgattattactgccagtcctatgacaacagcctgagtggttatgtcttcggaactgggaccaaggtcaccgtcctag

SEQ ID NO: 8388 - DNA, 331 bp, Artificial Sequence
  Synthetic construct
cagtctgtggtgactcagccaccctcagtgtctgggacccccggacagagggtctccatctcttgttctggaagcagctccaacctcggaagtaacactgttaattggtaccagcatcgctcaggatcggcccccaaagtcctcatctatagtaatgatctgcggccctcaggggtccctgaccgattctctggctccaagtctggcacctcagcctccctggccatcagtggcctccagtctggagatgaggctgattatttctgtgtcgtttgggatgtcagactgagtgggtatgtcttcggaactgggaccaaactcaccgtcctag

SEQ ID NO: 8389 - DNA, 322 bp, Artificial Sequence
  Synthetic construct
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccctacacttttggccaggggaccaagctggagatcaaac

SEQ ID NO: 8390 - DNA, 322 bp, Artificial Sequence
  Synthetic construct
gacatccagatgacccagtctccatcctccctgtctgcatctataggagacagagtcaccatcacttgccgggcaagtcagaacattggcaggtatttaaattggtatcagcaaaaaccagggaaagcccctaagctcctgatctatggtgcatccagtttccaaagtggggtcccatcaaggttcagtggcagttcatctgggacagatttcactctcaccatcaccagtctgcaacctgaagactttgcaacttactactgtcaacagggttacagtaccccattcactttcggccctgggactaaagtgggtatcagac

SEQ ID NO: 8391 - DNA, 325 bp, Artificial Sequence
  Synthetic construct
tcctatgtgctgactcagccaccctcggtgtcagtggccccaggacagacggccaggatcacctgtgggggaaacaacattatatctaaaagtgtgtattggtatcgacagaagtcaggccaggcccctttactggtcgtctctgatgatcgggaccggccctcagggatccctgagcgattttccggctccaattctgggaacacggccaccctgatcatctccagggtcgaagccggggatgaggccgactatttttgtcaggtgtgggatagtattagtgagcatcaagtgttcggcggagggaccaagctgaccgtcctag

SEQ ID NO: 8392 - DNA, 331 bp, Artificial Sequence
  Synthetic construct
cagtctgtgttgacgcagccgccctcagtgtctgcggccccaggacagaaggtcaccatctcctgctctggaaacatctccaacattgggactaattatgtttcctggtaccagcacttcccaggaacagcccccaaactcttcatttatgacaacaataagcgaccctcagggactcctgaccgagtccacggcttcaggtctggcacgtcagccaggttggtcatcaccgaactccacactggggacgaggccgattattactgcggagcctgggacagcagcctgagagcggtggtgttcggcggcgggaccaagctgaccgtcctag

SEQ ID NO: 8393 - DNA, 322 bp, Artificial Sequence
  Synthetic construct
gacatccagatgacccagtctccatcctccctgtctgcatctgtaggagacagagtcaccatcacttgccgggcgagtcagggcaatggctactctttagcctggtatcagcagaaaccagggaaagcccctaagctcctactctattctgcctccacattggaaagtggggtcccatccaggttcagtggcagtggatctgggacggattacactctcaccatcaccagcctgcagcctgaagatttagcgacttattattgtcaacagtattatagtctccctctcactttcggcggagggaccaaggtggagatcagac

SEQ ID NO: 8394 - DNA, 334 bp, Artificial Sequence
  Synthetic construct
cagtctgccctgactcagcctgcctccgtgtctgggtctcctggacactcgatcaccatctcctgcactggaaccagcagtgacgttggtggttataactatgtctcctggtaccaacaaaacccaggcaaagcccccaaactcatgatttatgatgtcaataatcggccctcagggatttctaatcgcttctctggctccaagtctggcaacacggcctccctgaccatctctgggctccaggctgacgacgaggctgattattactgcacctcatatacaaacgacaccaattctcaggtattcggcggagggaccaagctgaccgtcctag

SEQ ID NO: 8395 - DNA, 325 bp, Artificial Sequence
  Synthetic construct
gaaagtgtgttgacgcagtctccaggcaccctgtctgtgtctccaggggaaagagccaccctctcctgcagggccagtcagagtgttagcaacaactacttagcctggtaccagcagaaacctggccaggctcccaggctcctcatctatggtgcatacaccagggccactggcatcccagacaggttcagtggcagtgggtctgagacagacttcactctcaccatcagcagcctggagcctgaagattttgcagtgtatcactgtcagcagtatagttcctcacctcggacgttcggccaagggaccaaggtggaaatcaaac

SEQ ID NO: 8396 - DNA, 337 bp, Artificial Sequence
  Synthetic construct
gacattgtgatgactcagacccctcgcgccctgaccgtcagtccgggcgagccggcctccatctcctgcaggtccagccagagtctccgccatagtaaaggaatcacttttttggactggtatctgcagaggccagggcagtctccacaactcctgatctattcggtttctaatcgggcctccggggtccctgacaggttcagtggcgctggatcaggcacagatttcacactgaaaatcaacagcgtggagcctggcgacgtggggatttatttctgcatgcaaagtctacagactccgccgacgttcggcctagggaccaagttggaaatcaaac

SEQ ID NO: 8397 - DNA, 322 bp, Artificial Sequence
  Synthetic construct
gacatccagctgacccagtctccatcctccctgcctgcgtctattggagacacagtcaccatcacttgccgggcgagtcaaaacataaccaaccatttaaattggtatcagcagagacctgggaaggcccctaaactcctgatctttgctgcatttactttgcaaaacggggtcccatcaaagttcagtggcagtggatctgggacagatttcactctcaccatcatcggtctgcaacctgacgattttgcgacttactactgtcaacagagtttcagctccctttggacgttcggccaagggaccaaggtggtactccaac

SEQ ID NO: 8398 - DNA, 331 bp, Artificial Sequence
  Synthetic construct
cagtctgccctgactcagcctgcctccgtgtctgggtctcctggacagtcgatcaccatctcctgcactggatccagcagtgacgttggtacttataactatgtctcctggtatcaacaatacccaggcaaagcccccaaactcatgatttatgatgtcagtaatcggccctcagggatttctaatcgcttctctggctccaagtctggcaacacggcctccctgactatctctgggctccaggctgaggacgaggctgcttattactgcagctcctatacaagcggtcgtattctggttttcggcggagggaccaaactgaccgtccttg

SEQ ID NO: 8399 - DNA, 337 bp, Artificial Sequence
  Synthetic construct
aatattgtgatgactcagtctccattttccctgtccgtcacccctggagaggcggcctccatctcctgcaggtctagtcagagcctcctgcatactaatggatacaactatttggattggtatttgcagaagccagggcagtctccacagctcctgatctatctccgttctaatcgggcctccggggtccctgacagattcagtggcagtggatcaggcacagattttacactgaaaatcagcagagtggaggctgaggatgttggggtttattactgcatgcaaactctacaaactcctctcactttcggcggagggaccaaggtggagatcaaac

SEQ ID NO: 8400 - DNA, 322 bp, Artificial Sequence
  Synthetic construct
gccatccggatgacccagtctccatcctcactctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagtggcagtggatctgggacagatttcactctcaccatcagctgcctgcagtctgaagattttgcaacttattactgtcaacagtattatagttaccccctcactttcggcggagggaccaaggtggagatcaaac

SEQ ID NO: 8401 - DNA, 325 bp, Artificial Sequence
  Synthetic construct
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccattgggtgttcggcggagggaccaagctgaccgtcctag

SEQ ID NO: 8402 - DNA, 334 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacaaaacccaggcaaagcccccaaactcatgatttatgatgtcaataatcggccctcagggatttctaatcgcttctctggctccaagtctggcaacacggcctccctgaccatctctgggctccaggctgacgacgaggctgattattactgcacctcatatacaaacgacaccaattctcaggtattcggcggagggaccaagttgaccttcctag

SEQ ID NO: 8403 - DNA, 325 bp, Artificial Sequence
  Synthetic construct
gaaattgtgttgacgcagtctccaggcaccctgtctttgtctccaggggaaagagccaccctctcctgcagggccagtcagagtgtaagcagcagcttcttagcctggtaccagcagaaacctggccaggctcccaggctcctcatctatggtgcatccagcagggccactggcatcccagacaggttcagtggcagtgggtctgggacagacttcattctcaccatcagcagactggagcctgaagattttgcagtgtattgctgtcaccagtatagtacctcaccgtggacgttcggccgagggaccaaggtggaaatcaaac

SEQ ID NO: 8404 - DNA, 331 bp, Artificial Sequence
  Synthetic construct
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgaaaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaagctgaccgtcctag

SEQ ID NO: 8405 - DNA, 331 bp, Artificial Sequence
  Synthetic construct
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctaaagtattcggcggagggaccaagctgaccgtcctag

SEQ ID NO: 8406 - DNA, 325 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccccgtacacttttggccaggggaccaagctggagatcaaac

SEQ ID NO: 8407 - DNA, 126 bp, Artificial Sequence
  Synthetic construct
gcaacacggcctccctgaccatctctgggctccaggctgacgacgaggctgattattactgcacctcatatacaaacgacagcaattctcaggtattcggcggagggaccaagctgaccgtcctag

SEQ ID NO: 8408 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccaatttgcaaagtggggtcccatcaaggttcagtggcagtggatctgggacagatttcactctcaccatcagcagtctgcaacctgaagattttgcaacttactactgtcaacagagttacagtacccctagaacgttcggccaagggaccaaggtggaaatcaaac

SEQ ID NO: 8409 - DNA, 319 bp, Artificial Sequence
  Synthetic construct
gacatccagatgacccagtctccatcctccctgtctgcatttgttggagacagagtcaccatcacttgccaggcgagtcatgacattggcaaccatttaaattggtatcagcacaaacctgggaaagcccctaaactcctgatctacgatgtgtccaatttggatgtcggggccccatcgaggttcagcggaagtggatccgggacagagttcactttcaccatcaataacctgcagcctgatgatgttgcaatttattactgtcaacagtatgattatatccctcgcttcggccctgggaccaaagtggatttgaaac

SEQ ID NO: 8410 - DNA, 334 bp, Artificial Sequence
  Synthetic construct
cagtctgccctgactcaggctgcctccgtgtctgggtctcctggacagtcgatcaccatctcctgcactggaaccaacactgatgttgggagttataaccttgtctcctggtaccaaaaccacccaggcaaagcccccaaagtcttgatttatgagggcagtaagcggccctcaggggtttctaatcgcttctctggctccaagtctggcaacacggcctccctgacaatctctgggctccaggctgacgacgaggctgattattactgcacctcatatacaaacgacagcaattctcaggtattcggcggagggaccaagctgaccgtcctac

SEQ ID NO: 8411 - DNA, 319 bp, Artificial Sequence
  Synthetic construct
gccatccggataacccagtctccatcctcactctctgcatctacaggaggcagagtcaccatcacttgtcgggcgagtcagagtattgccacttatttagcctggtatcagcaaaaaccagggaaagcccctaagctcctgatctctggtgcttccactttgcaaagtggggtcccatcaaggtttagcggcagtggatctgggacagatttcactctcaccatcagctgcctgcagtctgaggatttcgcaacttattactgtcaacaatattattcttactctacgttcggccaagggaccaaggtggagctcaatc

SEQ ID NO: 8412 - DNA, 340 bp, Artificial Sequence
  Synthetic construct
gacatcgtgatgacccagtctccagcctccctggctgtgtctctgggcgagagggccaccatcaactgcaagtccagccagactattttattcaactccaacaataagaactacttagcttggtaccagcagaaaccaggacagcctcctaagctgctcatttactgggcatctacccgggaatccggggtccttgaccgattcagtggcagcgggtctgggacagatttcactctcaccatcagcagccttcaggctgaagatgtggcagtttattactgtcagcaatattttagtactccgtacacttttggccaggggaccaagctggagatcaaac

SEQ ID NO: 8413 - DNA, 325 bp, Artificial Sequence
  Synthetic construct
gaaattgtgttgacacagtctccagccaccctgtctttgtctccaggggaaagagccaccctctcctgcagggccagtcagagtgttagcagttacttagcctggtaccaacaaaaacctggccaggctcccaggctcctcatctatgatgcatccaacagggccactggcatcccagccaggttcagtggcagtgggtctgggacagacttcactctcaccatcagcagcctcgagcctgaagatttcgcagtttattactgtcagcagcgtagcacctggcctccggggactttcggccctgggaccaaagtggaaatcaaac

SEQ ID NO: 8414 - DNA, 322 bp, Artificial Sequence
  Synthetic construct
gacatccagatgacccagtctcctttcaccctgtctgcatctgtcggcgacagaatcaccatcacttgccgggccagtcagagtattaatagttggttggcctggtttcagcagaaaccagggaaagcccctaaactcctgatctatcagtcatcttctttagaaaatggggtcccatcaagattcagcggcagtgggtctgggacagaatttactctcaccatcagcagcctgcaggctgatgattttgcaacttattattgccaacaatatgagagttatccgatcactttcggccaagggacacgactggagattaaac

SEQ ID NO: 8415 - DNA, 322 bp, Artificial Sequence
  Synthetic construct
gccatccggatgactcagtctccatcctcactctctgcatctacaggagacagagtcaccatcacttgtcgggcgagtcttcatattagcacttatttagcctggtatcagcagaaaccagggaaagcccctaggctcctgatccatggtgcatccactttgcaaagtggggtcccatcaaggttcagcggcggtggatctgggacaaatttcactctcaccatcaactgcctgcagtctgaagattttgcaacatattactgtcaacattattataattaccctttcactttcggccctgggaccaaagtggatatcaaac

SEQ ID NO: 8416 - DNA, 308 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattctgcagtatattactgtcagcagtatggcagctcacctcccccgtacacttttggcca

SEQ ID NO: 8417 - DNA, 322 bp, Artificial Sequence
  Synthetic construct
gacatccagatgacccagtctccatctgccatatctgcatctgttggagacagagtcaccatcacttgtcgggcgagtcagcccatcagtcagtatttagcctggtttcagcagagaccagggaaagtccctaagcgcctgatctatggtgcatccactttgcaatatggggtcccatcaaggttcagcggtagtggatctgggacagaattcactctcacaatcagcagcctgcagcctgaagattttgcaacttattactgtctacagcataatagttaccctcggacgttcggccaagggaccaagttggaaatcaaac

SEQ ID NO: 8418 - DNA, 340 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctcctcatttactgggcatctacccgggaatccggggtccctgcccgattcagtggcagcgggtctgggacagatttcactctcaccatcagcagcctgcaggctgaagatgtggcagtgtattactgtcaacaatattataatactccgtacacttttggccaggggaccaagctggagatcaaac

SEQ ID NO: 8419 - DNA, 322 bp, Artificial Sequence
  Synthetic construct
gaaatagtgatgacgcagtctctagccaccctgtctgtgtctcgaggggaaagagccaccctctcctgcagggccagtcagagtgttagcagcaacttagtctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcacacttttggccaggggaccaagctggagatcaaac

SEQ ID NO: 8420 - DNA, 334 bp, Artificial Sequence
  Synthetic construct
cagcttgtgctgagtcaatcgccctctgcctctgcctccctgggagcctcggtcaaactcacctgcactctgagcagtgagcacgacacctatgccatcgcatggcatcagcagcagccagagaagggccctcgatatttgatgaagattaaaagtgatggcagttacaacaagggggacgggatccctggtcgcttctcaggctccagctctggggctgagcgctacctcaccatctccagcctccagtctgaggatgaagctgactattattgtcagacctggggcaaaggcattcaggtgtttggcggagggaccaagttgaccgtcctac

SEQ ID NO: 8421 - DNA, 334 bp, Artificial Sequence
  Synthetic construct
cagtctgtgctgacgcagccgccctcagtgtctggggccccagggcagagggtcaccatctcctgcaatgggagcagctccaacatcggggcagattatgatattcactggtaccaacagattcaaggagcagcccccaaactcctcatctatggtaacatcaatcggccctcaggggtccctgaccgaatctctggctccaagtctggcacctcagcctccctggccatcgctgggctccaacctgcggatgaggctgattattactgtcagtcctatgacaacagcctgagaacttcggtgttcggcggtgggaccaagctgaccgtcctag

SEQ ID NO: 8422 - DNA, 322 bp, Artificial Sequence
  Synthetic construct
gaaatagtgatgacgcagtctccagccaccctgtctgtgtctccaggggaaagagccaccctctcctgcagggccagtcagagtgttagcaccaacttagcctggtaccagcagaaacctggccaggctcccaggctcctcatctttggtgcatccaccagggccactggtatcccagccaggttcagtggcagtgggtctgggacagagttcactctcaccatcagcagcctgcagtctgaagattttgcagtttactactgtcaccaatataaaaacgcggggtggacgttcggccaagggaccaaggtggaaatcaaac

SEQ ID NO: 8423 - DNA, 322 bp, Artificial Sequence
  Synthetic construct
gaaattgtgttgacacagtctccagccaccctgtctttgtctccaggggaaagagccaccctctcctgcagggccagtcagagtgttaacacttactttgcctggtaccaacagaaacctggccaggctccccgactcctcatctatgaagcatctctcagggcccctggcatcccagccaggttcagtggcagtgggtctgggacagacttcactctcatcatcaacaacctcgagcctgaagattttgcgatttattcctgtcagcagcgtgacacctggccttggacgttcggccaggggaccagggtggaaatcaagc

SEQ ID NO: 8424 - DNA, 322 bp, Artificial Sequence
  Synthetic construct
gccatccagttgacccagtctccatcctccctgtctgcatctgttggagacagagtcaccatcacttgccgggcaagtcagggcattcgcagtgctttagcctggtatcagcagaaaccagggaaagttcctaagctcctaatctatgatgcctccagtttggaaagtggggtcccatcaaggttcagcggcagtggatctgggacagagttcactctcaccatcagcagcctgcagcctgaggattttgcaatttattactgtcaacagtttaatagttaccctcgcactttcggccctgggaccaaagtggatttcaaac

SEQ ID NO: 8425 - DNA, 328 bp, Artificial Sequence
  Synthetic construct
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgcttgggtgttcggcggagggaccaagctgaccgtcctag

SEQ ID NO: 8426 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacttatcaccttcggccaagggacacgactggagattaaac

SEQ ID NO: 8427 - DNA, 322 bp, Artificial Sequence
  Synthetic construct
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggccctgggaccaaagtggatatcaaac

SEQ ID NO: 8428 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggcggagggaccaaggtggagatcaaac

SEQ ID NO: 8429 - DNA, 322 bp, Artificial Sequence
  Synthetic construct
gacatccagatgacccagtctccttccaccctgtctccatctgtaggagacagagtcactatcacttgtcgggccagtcagagtattagtagctggttggcctggtatcagcagaaaccagggaaagcccctaagctcctgatctataaggcgtctagtttagaaactggggtcccatcaaggttcagcggcagtggatctgggacagaattcactctcaccatcagcagcctgcagcctgatgattttgcaacttattactgccaacagtataatagttatccgtacacttttggccaggggaccaagctggagatcaaac

SEQ ID NO: 8430 - DNA, 322 bp, Artificial Sequence
  Synthetic construct
gtcatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagttgcctgcagtctgaagattttgcaacttattactgtcaacagtattatagtttcccgctcactttcggcggagggaccaaggtggagatcaaac

SEQ ID NO: 8431 - DNA, 322 bp, Artificial Sequence
  Synthetic construct
gacatccagatgacccagtctccttccaccctgtctgcatctgtaggagacagagtcaccatcacttgccgggccagtcagacaattagtagctggttggcctggtatcagcagaagccagggaaagcccctaaactcctgatctttaaggcatctactttagaaagtggggtcccatcaaggttcagcggcagtgcatctgagacagaattcactctcaccatcagcagcctgcagcctgatgattttgcaacttattattgccaacagtataatagttatttgtggacgttcggccaagggaccaaggtggaaatcaaac

SEQ ID NO: 8432 - DNA, 328 bp, Artificial Sequence
  Synthetic construct
gaaattgtgttgacgcagtctccaggcaccctgtctttgtctccaggggaaagagccaccctctcctgcagggccagtcagagtgttagaagcagctacttagcctggtaccagcagaaacctggccaggctcccaggctcctcatctatggtgcatccaacagggccactggcatcccagacaggttcagtggcagtgggtctgggacagacttcactctcaccatcagcaggctggagcctgaagattttgcagtgtattactgtcagcagtatggtagctcaccactattcactttcggccctgggaccaaagtggatatcaaag

SEQ ID NO: 8433 - DNA, 325 bp, Artificial Sequence
  Synthetic construct
tcttctgagctgactcaggaccctgctgtgtctgtggccttgggacagacagtcaggatcacatgccaaggagacagtctcagaggctattatggatgctggtaccagcagaaggcaggacaggcccctgtacttgtcatctatggtaaaaacaaccggccctcagggatcccagaccgattctctggctccacttcaggaaacacagcttccttgaccatcactggggctcaggcggaagatgaggctgactattattgtaactcccgggacagcagtggtaaccatgtggtcttcggcggagggaccaagctgaccgtcctag

SEQ ID NO: 8434 - DNA, 322 bp, Artificial Sequence
  Synthetic construct
ggcatccagatgacccagtctccttcctccctgtctgcatctgttggagacagagtcaccatcacttgccaggcgagtcaggacattagcaattatttaaattggtatcaacaaaagccagggaaagcccctcacctcctgatctacgatgcgtccaatttgcagacaggggtcccatcaaggttcagtggaagtggatctgggacagattttactttcaccatcagcagcctgcagcctgaagatattgcaacatattactgtcaacagtttgataatctccctatcaccttcggccaagggacacgactggagattaaac

SEQ ID NO: 8435 - DNA, 213 bp, Artificial Sequence
  Synthetic construct
acccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacaacagcaattctcaggtattcggcggagggaccaagctgaccgtcctag

SEQ ID NO: 8436 - DNA, 322 bp, Artificial Sequence
  Synthetic construct
gacttccagatgacccagtctccatcctccctgtctgcatctgtaggagacagaatcaccatctcttgccgggcaactcagaccattattaactatttaaattggtatcagcaaaaaccagggaaagcccctaatttcctgatctttggtgcatccactttgcaaagtggggtcccaccaaggttcagtggcagtggatctgggacaaatttcactctcaccatcaccaatctgcaacctgaagattttgcaacttactactgtcaacagagttacagcatcccgtacacttttggccaggggaccaagctggaggtcaaac

SEQ ID NO: 8437 - DNA, 340 bp, Artificial Sequence
  Synthetic construct
gatattgtgatgacccagactccactctccctgcccgtcacccctggagagccggcctccatctcctgcaggtctagtcagagcctcttggatagtgatgatggaagcacctatttggactggtacctgcagaagccagggcagtctccacagctcctaatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttggacgttcggccaagggaccaaggtggaaatcaaac

SEQ ID NO: 8438 - DNA, 322 bp, Artificial Sequence
  Synthetic construct
gacatccagatgacccagtctccttccgccctgtctgcatctgtaggagacagagtcaccatcacttgccgggccagtcagagtattagtacctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgtgacttattactgccaacactataatggttatccgtggacgttcggccaagggaccaaggtggaaatcaaac

SEQ ID NO: 8439 - DNA, 322 bp, Artificial Sequence
  Synthetic construct
gccatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctcctcatttcggcggagggaccaaggtggagatcaaac

SEQ ID NO: 8440 - DNA, 331 bp, Artificial Sequence
  Synthetic construct
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgtcctag

SEQ ID NO: 8441 - DNA, 322 bp, Artificial Sequence
  Synthetic construct
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccgtacacttttggccaggggaccaagctggagatcaaac

SEQ ID NO: 8442 - DNA, 322 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgtacacttttggccaggggaccaagctggagatcaaac

SEQ ID NO: 8443 - DNA, 322 bp, Artificial Sequence
  Synthetic construct
gacatccagatgacccagtctccatcctccctgtctgcatctgtaggagacagagtcaccatcacttgccgggcaagtcagagcattagcagctttttaaattggtatcagcagaaaccagggaaagcccctaagctcctgatctatgctgcatccagtttgcaaagtggggtcccatcaaggttcagtggcagtggatttgggacagatttcactctcaccatcagcagtctgcaacctgaagattttgcaacttactactgtcaacagagttacagtaccctctacacttttggccaggggaccaagctggagatcaaac

SEQ ID NO: 8444 - DNA, 343 bp, Artificial Sequence
  Synthetic construct
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctgaggtgctcatttactgggcatctacccgggaatccggggtccctgaccgattcagtggcagcgggtctgggacagatttcactctcaccatcagcagcctgcaggctgaagatgtggcagtttattactgtcagcaatattatactactcccacgtggacgttcggccaagggaccaaggtggaaatcaaac

SEQ ID NO: 8445 - DNA, 193 bp, Artificial Sequence
  Synthetic construct
ctgctcgtctatgatgacaaacaccggccctcagggatccctgagcgattctctggctccaattctgactccacggccacccttagcatcagcagtgtcgaggcctgggatgaggccgactattactgccaggtgtgggataacactgatgatcctgtggtattcggcggagggaccaagctgaccgtcctag

SEQ ID NO: 8446 - DNA, 322 bp, Artificial Sequence
  Synthetic construct
gacatccagatgacccagtctccatcctccctgtctgcttctgtaggcgaaagagtcaccatcacttgccgggcgagtcagaccattgcaaagtctttaaattggtatcagcacaagtcagggacagcccctaaactactaatctctgctgcatccactttgaaaagtggggtcccatcaaggttcagtggcagtggatctgggacagagttcactctcaccatcagcagtctgcaacctgaagattttgcaacttactattgtcagcagagtctcagtaccctgatcacttttggccaggggaccaagctggagatcagac

SEQ ID NO: 8447 - DNA, 322 bp, Artificial Sequence
  Synthetic construct
gacatccagatgacccagtctccatcctccctgtctgcatctgtaggagacagagtcaccatcacttgccgggcaggtcagagcatttacaactatttaaattggtatcagcagagaccagggaaagcccctaacctcctgatctatgctgcgtccagtttgcgaagtggggtcccgtcaaggttcagtggcagtggatctgggacagatttcactctcaccatcagcagtctgcaacctgaagattttgcagcttactactgtcaacagagttacattacccctctcactttcggccctgggaccaaaatagatattaaac

SEQ ID NO: 8448 - DNA, 331 bp, Artificial Sequence
  Synthetic construct
cagtctgccctgactcagcctgcctccgtgtctgggtctcctggacagtcgatcaccatctcctgcactggaaccagcaatgattttgggacttataaccttgtctcctggtaccaacagcacccaggcagaacccccaaactcataatttatgagggcactcagcggccctcagggatttctgatcgcttctctggctccaagtctggcaacacggcctccctgacaatctctgggctccaggctgaggacgaggctgattatttctgctcctcatacgcaagtgggggcactgtggttttcggcggagggaccaagctgaccgtcctag

SEQ ID NO: 8449 - DNA, 322 bp, Artificial Sequence
  Synthetic construct
gaaattgtgttgacacagtctccagccaccctgtctttgtctccaggggagagagccaccctctcatgcagggccagtcagagtgttagcagctatttagcctggtaccaacagaaacctggccagcctcccaggctcctcatctatggtgcatccaacagggccactggcatcccagccagattcggtggcagtgggtctgggacagacttcattctcaccatcagcagcctagagcctgaagattttgcagtgtattactgtcagcagggtaacaactggccgctcactttcggcggtgggaccaaggtggagatcaagc

SEQ ID NO: 8450 - DNA, 322 bp, Artificial Sequence
  Synthetic construct
tccgatgaactgactcagccaccctcagtgtccgtgtccccagggcagacagccaccatcacctgctctggagatgaattgggggaaaaatttacttcttggtatcaacagaagccaggccagtcccctgtattggtcatctatcaagattccaagcgcccctcagggatccctgagcgaatctctggctccaactctgggaacacagccactctgaccatcaccggggcccaggctatggatgaggctgactattactgtcagacttgggacagcagcacttcttatctcttcggacctggcaccaaagtcaccgtcctgg

SEQ ID NO: 8451 - DNA, 343 bp, Artificial Sequence
  Synthetic construct
gacatcgtgatgacccagtctcctgactccctggctgtgtctctgggcgagagggccaccatcaactgcaggtccagccagagtcttttatacagctccgacaatatgaactacttagcttggtatcagcagaaaccagggcagcctcctaaactcctcctttactgggcttctacccgggaatccggggtccctgaccgattcagtggcagcgggtctggagtgaatttcactctcaccatcagcagcctgcaggctacagatgtggcagtttattactgtcagcaatattatagtgctcctccctggacgttcggccaagggaccaaggtggagatcaaac

SEQ ID NO: 8452 - DNA, 331 bp, Artificial Sequence
  Synthetic construct
cagtctgttttgactcagccaccctcagcgtctgggacccccggacagagggtcaccatctcttgttctggaagcagctccaacatcggagataatcctgtgaagtggtaccagcaggtcccaggaacggcgcccaaactcctcatttatagtactgatcagcggccctcaggggtccctgcccgattctctggctccaagtttggcacctcagcctccctggccatcagtgggctccggtctgcggatgaggctgtttatttctgtgcaacatgggatgacagtctgaatgctgtggttttcggcggagggaccaagttgaccgtcctgg

SEQ ID NO: 8453 - DNA, 337 bp, Artificial Sequence
  Synthetic construct
cagtctgtattgacgcagccgccctcagtgtctgcggccccaggacagaaggtcaccatctcctgctctggaaacacctccaatattggcaatcattttgtttcgtggtaccaacacctcccaggaacagcccccaaactcgtcatctatgaaagttataagcgaccctcagggattcctgaccgattctctggctccaagtctggcacgtcagccaccctggaaatcagcggactccagcctggggacgaggccgattattattgcgaagcatgggagagcagcctgagtggtggccatggggtcttcggcggagggaccaagctgaccgtcctta

SEQ ID NO: 8454 - DNA, 322 bp, Artificial Sequence
  Synthetic construct
gccatccagttgacccagtctccctcctccctgtctgcatctgtgggagacagagtcaccatcacttgccgggccagtcagggcattaatagttatctagcctggtatcaacaaggaccagggaaagcccctaagctcctgatctatgctgcatccactttgcaaagtggggtcccatcaaggttcagcggcagtggatctgggacagatttcactctcaccatcagcagcctgcagcctgaagatgttgcaacttattactgtcaacaacttaatacttaccctcggactttcggccctgggaccaaggtggatctcaaac

SEQ ID NO: 8455 - DNA, 322 bp, Artificial Sequence
  Synthetic construct
gacatccagatgacccagtctccatcctccctgtctgcatctgtaggagacagagtcaccctcacttgccgggcaagtcagagcattagcggctatttaaattggtatcagcaaaaaccagggaaagcccctcagctcctgatctatgctgcatccagtttgcaaagtggggtcccgtcaaggttcagtggcagtggatctgggacagatttcactctcaccatcagcagtctgcaacctgaagattttgcaaccttctactgtcaacagagttacaagttccctcggacgttcggccaagggaccaaggtggagatcaaac

SEQ ID NO: 8456 - DNA, 334 bp, Artificial Sequence
  Synthetic construct
cagtctgtgctgacgcagccgccctcagtgtctggggccccagggcagagggtcaccatctcctgcactgggagcagctccaacatcggggcaggttttgatgtacactggtatcagaaacttccaggagtagcccccaaactcctcatctatggtaacaccaatcggccctcaggggtccctgaccgattctctggctccaagtctggcacctcagcctccctggccatcactgggctccaggctgaggatgaggctgattattactgccagtcctatgacagcagcctgagtggtgtggttttcggcggagggaccaagctgaccgtcctac

SEQ ID NO: 8457 - DNA, 228 bp, Artificial Sequence
  Synthetic construct
gggggttccagcagaagccaggccaggcccctgtgttggtgatatataaagacagtgagaggccctcagggatccctgagcgattctctggctccagctcagggacaacagtcacgttgaccatcagtggagtccaggcagaagacgaggctgactattactgtcaatcagcagacagcagtgattcttatagggtcttcggaactgggaccaaggtcaccgtcctag

SEQ ID NO: 8458 - DNA, 325 bp, Artificial Sequence
  Synthetic construct
gatattgtgttgacgcagtctcccggcaccctgtctttgtctccaggggaaagagccaccctctcctgcagggccagtcaaagtgttagcagcaactacttagcctggtaccagcagaaacctggccaggctcccaggctcctcatctatagaacatccaccagggccactggcatctcagacaggttcagtggccgtgggtctgggacagacttcactctcaccatcagcagactggagcctgaagattttgcagtgtattactgtcagtactatggtggctcaccaaagacgttcggccaagggaccaaggtggaaatcaaac

SEQ ID NO: 8459 - DNA, 319 bp, Artificial Sequence
  Synthetic construct
gacatccagatgacccagtctccttccaccctgtctgcttctgtaggagacagagtcaccatcacttgccgggccagtcagagtattaatactagggtggcctggtatcagcagaaaccagggaaagcccctaagctcctcatctatcaggcatctactttagaaactggggtcccatcgaggttcatcggcagtggatctgggacagagttcactctgaccatcagcagcctacagcctgatgattttgcaatttattactgccaacattattatagtcaaacaatgttcggccaagggaccaaggtggacatcaaac

SEQ ID NO: 8460 - DNA, 322 bp, Artificial Sequence
  Synthetic construct
gacatccagatgacccagtctccatcctccctgtctgcatctgtaggagacagagtcaccatcgcttgccgggcaagtcagagcatatccacctatgtaaattggtatcagcagaaaccagggaaagcccctaacctcctgatctatgctgcatccagtttgcagagtggggtcccatcaaggttcagtggcagtggatctgggacagatttcactctcaccatcagcaatctgcaacctgaggactttgcaacttactactgtcaacagagtgacagtaccctgccctctttcggcggagggaccagggtggagatcaacc

SEQ ID NO: 8461 - DNA, 325 bp, Artificial Sequence
  Synthetic construct
gaaattgtgttgacgcagtctccaggcaccctgtctttgtctccaggggaaagagccaccctctcctgcagggccagtcagactattatcagcaactatttagcctggtaccagcaaaaacctggccaggctcccaggctcctcatctttggtgcctccatcagggcctctggcatcccagacaggttcagtggcagtgggtctgggatcgacttcactctcaccatcaacagactggagcctgaggattttgcagtgtatcactgtcagcagtatggtagctcactctggacgttcggccaagggaccaaggtggaattgaaac

SEQ ID NO: 8462 - DNA, 334 bp, Artificial Sequence
  Synthetic construct
cagtctgttctgacgcagccgccctcagtgtctggggccccagggcagagggtcaccatctcctgcattgggagcagctccaatatcggggcgagttctggtgttcactggtatcagcttcttccaggaacagcccccaaactcctcatctatcttaactccaaacggccctcaggggtccctgaccgattctctggctccaagtctggcacctcagcctccctggccatcactgggctccaggctgaggatgaggctgtttattactgccagtcccatgacaccagccttcctggttcggtgttcggcggagggacccagttgaccgtcctag

SEQ ID NO: 8463 - DNA, 322 bp, Artificial Sequence
  Synthetic construct
gacatccagatgacccagtctccatcctccctgtctgcgtctgtaggagacacagtcaccatcacttgccgggcaagtcagaacataaccaaccatttaaattggtatcaacagagacctgggaaggcccctaaactcctgatctttgctggttatagtttgcaaaatggggtcccatcaaagttcagtggcagtggatctgggacagattttactctcaccatcagcggtctacaacctgaggattttgcgacttactactgtcaacagagtttcagttccgtttggacgttcggccaagggaccaaggtggaggtccaac

SEQ ID NO: 8464 - DNA, 322 bp, Artificial Sequence
  Synthetic construct
gaagtagtgctgacgcagtctccagcctccctgtctctggctccaggggaaagagccaccctctcttgcagggccagtcagagtgtgagcagcaacttagcctggtaccagcaaaagggtggccaggctcccaggctcctcattcatgattcatcctccagggccgctgacatcccgtccaggttcagtggcagtgggtctgggacagaattcactctcaccatcagcagcctgcagtctgaagattctgcagtttactactgcctgcagtatgatcactggatttacacttttggccaggggaccaggctggagatcaaac

SEQ ID NO: 8465 - DNA, 337 bp, Artificial Sequence
  Synthetic construct
gatgttgtgatgactcagtctccactctccctgcccgtcacccttggacagccggccttcatctcctgcaggtccagtcacgccctcgttcacagtgatggagacacttacttaaattggcttcaggagaggccaggccaatctccaaggcgccttatttatcaggtttttaagcgggacgctggggtcccagacagattcgacggcagtgggtcaggcactgacttcacactgaagatcaatagggtggaggctgaggatcttggaatttattactgcatgcaaggtacacattggcctccgggcttcggccaagggacacgactggagcttaatc

SEQ ID NO: 8466 - DNA, 290 bp, Artificial Sequence
  Synthetic construct
ggggtctttgtctccaggggaaagggccaccctctcctgcagggccagtcagagtgttgacagctacttagcctggtaccaacagaaacctggccaggctcccaggctcctcatctatgatgtgtccaacagggccactggcatcccagcccggttcagtggcagtgggtctgggacagacttcactctcaccatcagtagcctagagtctgaagattttgcaatttactactgtcagcagcgtagcgactggctcactttcggcggagggaccaaggtggagatcaagc

SEQ ID NO: 8467 - DNA, 334 bp, Artificial Sequence
  Synthetic construct
cagtctgtcctgactcagcctgcctccgtgtctgggtctcctggacagtcgatcaccatctcctgctctggatccagcgatgacgttggtgcttttgactatgtctcctggtaccaacaacaaccagggaaagcccccagactcttgatctttgaagtcagtaatcggccctcaggaatttctgatcgcttctctgcctccaagtctggcaatacggcctccctgaccatctctgggctccagattgaggacgagggggactatagttgctgctcatattcaagaggggacaccctgtatgtcttcgggtctgggaccacggtcgccgtcctcg

SEQ ID NO: 8468 - DNA, 325 bp, Artificial Sequence
  Synthetic construct
tcctatgtcctgactcagccaccgtcggtgtcagtggccccaggacagacggccagactttcctgtgggggcgacaacattggatataaaagtgtacactggtatcagaagaggccaggccaggccccggtgctgctcgtctatgatgacaaacaccggccctcagggatccctgagcgattctctggctccaattctgactccacggccacccttagcatcagcagtgtcgaggccggggatgaggccgactattactgccaggtgtgggataacactgatgatcctgtggtattcggcggagggaccaagctgaccgtcctag

SEQ ID NO: 8469 - DNA, 340 bp, Artificial Sequence
  Synthetic construct
gacatcgtgatgacccagtctccagaatttctggctgtgtctctgggcgagagggcctccatcaactgcaagtccagccagagtgttttaaacacctccaacaataagaactacctagcttggtatcagcagaaaccaggacagcgtcctaagttgctcatttattgggcatctactcgggagtccggggtccctgaccgattcagtggcagcgggtctgggacagatttcactctcaccatcagcagcctgcaggctgaggatgtggcagtttatttctgtcagcaatattataataagcctcccacttttggccaggggaccaagttggagatcaaac

SEQ ID NO: 8470 - DNA, 319 bp, Artificial Sequence
  Synthetic construct
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcgagcggccctcagggatccctgagcgattctctggctccaactctgggaacacagccactctgaccatcagcgggacccaggctatggatgaggctgactattactgtcaggcgtgggacagcagcactgtgctattcggcggagggaccaagctgaccgtcctag

SEQ ID NO: 8471 - DNA, 325 bp, Artificial Sequence
  Synthetic construct
gaaattgtgttgacgcagtctccaggcaccctgtctttgtctccaggggaaagagccaccctctcctgcagggccagtcagagtgtcgccggcggccacgtagcctggttccagtataatgttggccggcctcccaggctcctcatctatggagcaaccacccggcccactgacatcccagacaggttcagtggcagtgggtctgggacagacttcactctcaccatcagcagactggagcctgaagattttgcaacatattactgtcagcaatatactctctcgcctcacaattttggtcaggggaccaagctggagatcagac

SEQ ID NO: 8472 - DNA, 334 bp, Artificial Sequence
  Synthetic construct
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacaacaatcggccctcaggggtccctgaccgagtctctgagtccaagtctggcacctcagcctccctggccatcactgggctccaggctgaggatgaggctgattattattgccagtcctatgacagcagcctgagtggtcatgttttcggaactgggaccaaggtcaccgtcctag

SEQ ID NO: 8473 - DNA, 322 bp, Artificial Sequence
  Synthetic construct
gacatccagatgacccagtctccatcctccctgtctgcatctataggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacattaccccgtggacgttcggccaagggaccaaggtggagatcaaac

SEQ ID NO: 8474 - DNA, 331 bp, Artificial Sequence
  Synthetic construct
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttggtgttcggcggagggaccaagctgaccgtcctag

SEQ ID NO: 8475 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaagattcagtggcagtggatctgggacagatttcactctcaccatcagcagtctgcaacctgaagattttgcaacttactactgtcaacagagttacagtacccctcggacttttggccaggggaccaagctggagatcaaac

SEQ ID NO: 8476 - DNA, 328 bp, Artificial Sequence
  Synthetic construct
tcctatgtactgactcagccaccctcagtgtccgcggccccaggaaagacggccaggattacctgtgggggaaacaacattggaggtatacgtgtccactggtaccagcagaagccaggccaggcccctgtgttggtcgtctatgatgatagcgaccggccctcagggatccctgagcgattctctggctccaactctgggaacacggccaccctgaccatcagcagggtcgaagccggggatgaggccgactattactgtcaggtgtgggataatagtagtgatcatcctttagtattcggcggagggaccaggctgaccgtcctag

SEQ ID NO: 8477 - DNA, 325 bp, Artificial Sequence
  Synthetic construct
gccatccagatgacccagtctccatcctccctgtctgcatctgtaggagacagagtcaccatcacttgccgggcaagtcagggcattagaaatgatttaggctggtatcagcagaaaccagggacagcccctaagctcctgatctatgctgcatccagtttacaaagtggggtcccatcaaggttcagcggcagtggatctggcacagaattcactctcaccatcagcagcctgcagcctgaagattttgcaacttattactgtcttcaggattccaattacccttttgtcacttttggccaggggaccaagctggagatcaaac

SEQ ID NO: 8478 - DNA, 322 bp, Artificial Sequence
  Synthetic construct
gccatccggatgacccagtctccatcctcactctctgcatctacaggagacagagtcaccgtcacttgtcgcgcgagtcagggtattagtagttatttagcctggtatcagctaaaaccagggaaagcccctaagctcctgatctatgctacatccactttgcaaagtggggtcccatcaaggttcagtggcagtggatctgggacagatttcactctcaccatcagctgcctgcagtctgaagattttgcaacttattactgtcaacagtattatagttacccgtacacttttggccaggggaccaagctggggatcaaac

SEQ ID NO: 8479 - DNA, 322 bp, Artificial Sequence
  Synthetic construct
gacatccaaatgacccagtctccatcctccctgtctgcatctgtaggagacagagtcaccatcacttgccgggcaagtcagagcattagtgacaatttaaattggtatcagcacaaaccagggaaagcccctaagttcctgatttatgctgcatccagtttgcaaagtggggtcccatcaaggttcagtggcagtggatctgggacagatttcactctcaccatcagcagtctgcaacctgaagattttgcaacttacttctgtcaacagagtttcactacccctcccacttttggccaggggaccaagctggagatcagag

SEQ ID NO: 8480 - DNA, 322 bp, Artificial Sequence
  Synthetic construct
gaaatagtgatgacgcagtctccagccaccctgtttgtgtctccagggcaaagagtcaccctctcctgcagggccagtcagagaattgacaataaattagcctggtaccaactgaaacctggccaggctcccaggctcctcatctatggtgcgtccaacacggccactggtttcccagccaggttcagtggcagtgggtctgggacagagttcactctcaccatcagcagcctgcagtctgaagattttgccgtttattactgtcagcaatatgatacgtggcctcggacttttggccaggggaccaagctggagatcaaac

SEQ ID NO: 8481 - DNA, 334 bp, Artificial Sequence
  Synthetic construct
cagtctgccctgactcagtctgcctccgtgtctgggtctcctggacagtcgatcaccatctcctgcactggaaccagcagtgatgttgggaattataaccttgtctcctggtaccaacaacacccaggcaaagcccccaaactcatgatttatgaggtcaataagcggccctcaggggtttctaatcgcttctctggctccaagtctggcaacacggcctccctgacaatctctgggctccaggctgaggacgaggctgattattactgctgctcatatgcaggcaggaactcggggaatgtcttcggaactggcaccaaggtcaccgtcctgc

SEQ ID NO: 8482 - DNA, 325 bp, Artificial Sequence
  Synthetic construct
tcctatgagctgactcagccacactcagtgtcagtggccacagcacagatggccaagatcacctgtgggggaaacaatattggaactaaagctgtgcactggtgccagcaaacgccaggccaggaccctctgctggtcatctatagcgataacaaccggccctcagggatccctgagcgattctctggctccaacccagggaataccgccaccctaaccatcagcaggatcgaggctgggggtgagactgactattactgtcaggtgtgggacagtagtagtgatcatccggtattcggcggagggaccaagctgaccgtcctag

SEQ ID NO: 8483 - DNA, 322 bp, Artificial Sequence
  Synthetic construct
gacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatagtgcatccagagtggaaagtggggtcccatccaggttcagtggcagtggatctgggacggattacactctcaccatcagcagcctgcagcctgaagattttgcaacttattactgtcaacagtattatagttccccgtacacttttggccaggggaccaagctggagatcaaac

SEQ ID NO: 8484 - DNA, 212 bp, Artificial Sequence
  Synthetic construct
cccaggcaaagcccccaaactcatgatttatgatgtcagtaatcggccctcagggatttctaatcgcttctctggctccaagtctggcaacacggcctccctgaccatctctgggctccaggctgacgacgaggctgattattactgcacctcatatacaaacgacagcaattctcaggtcttcggcggagggaccaagctgaccgtcctag

SEQ ID NO: 8485 - DNA, 325 bp, Artificial Sequence
  Synthetic construct
tcctatgtgttgactcagccaccctcagtgtcagtggccccaggaaagacggccaggattccctgtgggggacagaatattgaaagtaagagtgtgcactggtaccgacagaagccaggccaggcccctgttttggtcgtctatgatgatcgcgaccggccctcagggatccctgcgcgaatctctggctccaactctggaaacatggccaccctgaccatcagcggggtcgaagccggggatgaggccgactattattgtcaggtgtgggaccattctaatgatcattttgtcttcggaggtgggaccaagatcaccgtcgtag

SEQ ID NO: 8486 - DNA, 334 bp, Artificial Sequence
  Synthetic construct
cagtctgtgttgacgcagccgccctcagtgtctggggccccagggcagagggtcaccctctcctgcactgggagcagctccaacatcggggcaggttatgatgtacactggtaccagcaacttccaggaacagcccccaaactcctcatctatcttaacagcaatcgaccctcaggggtccctgaccgattctctggctccaagtctggcacctcagcctccctggccatcactgggctccaggctgaggatgaggctgattattactgccagtcctttgacagcagcctgagtggttttgtcttcggaactgggaccaaggtcaccgtcctag

SEQ ID NO: 8487 - DNA, 331 bp, Artificial Sequence
  Synthetic construct
cagtctgtgttgacgcagccgccctcagtgtctgcggccccaggacagaaggtcaccatctcctgctctggaagcagctccaacattgggaaaaattctgtctcctggtaccagcaactcccaggaacagcccccagactcctcatctatgaaaataatatgcgaccctcactgattcctgaccgattctctgcctctaagtccggcacgtcagccaccctggacatcaccggactccagactggggacgaggccgattattactgcggaacatgggatagcagcctgactgctggggtcttcggcggcgggaccaaggtgaccgtcctag

SEQ ID NO: 8488 - DNA, 325 bp, Artificial Sequence
  Synthetic construct
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggaccgacttcactctcaccatcagcagactggagcctgaagattttgcagtgtattactgtcagcagtatggttcctctttattcactttcggccctgggaccaaagtggatatcagac

SEQ ID NO: 8489 - DNA, 322 bp, Artificial Sequence
  Synthetic construct
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgacgttcggccaagggaccaaggtggaaatcaaac

SEQ ID NO: 8490 - DNA, 337 bp, Artificial Sequence
  Synthetic construct
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctaatctatgaagtttccagccggttctctggagtgccagataggttcagtggcagcgggtcagggacagatttcacactgaaaatcagccgggtggaggctgaggatgttggggtttattactgcatgcaaggtatacaccttccgtggacgttcggccaagggaccaaggtggaaatcaaac

SEQ ID NO: 8491 - DNA, 331 bp, Artificial Sequence
  Synthetic construct
cagtctgtgctgactcagccaccctcagcgtctgggacccccgggctgagggtcaccatctcttgttctggaagcacctccaacatcggaagtaatactgtaaactggtaccagcagctcccaggaacggcccccaaactcctcatctatagtagtaatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctag

SEQ ID NO: 8492 - DNA, 325 bp, Artificial Sequence
  Synthetic construct
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcattgggtgttcggcggagggaccaagctgaccgtcctag

SEQ ID NO: 8493 - DNA, 328 bp, Artificial Sequence
  Synthetic construct
gaaatagtgatgacgcagtctccagccaccctgtctgtgtctccaggggaaagagccaccctctcctgcagggccagtcagagtgttagcagcaacttagcctggtatcagcagaagcctggccaggctcccagactcctcatctatggtgcttccaccagggccactggtatcccagccaggttcagtggcagtgggtctgggacagagttcactctcaccatcagcggcctgcagtctgaagattttgcagtttatttctgtcagcagtataataactggcctcccaaatacacttttggccaggggaccaagctggagatcaaac

SEQ ID NO: 8494 - DNA, 334 bp, Artificial Sequence
  Synthetic construct
cagtctgccctgactcagcctgcctccgtgtctgggtctcctggacagtcgatcaccatctcctgcactggaaccagcagtgatgttggaagttataaccttgtctcctggtaccaacagcacccaggcaaagcccccaaactcatgatttctgaggtcagtaagcggccctcaggggtttctaatcgcttctctggctccaagtctggcaacacggcctccctgacaatctctggactccaggctgaggacgaggctgattattactgctgctcatatgcaggtagtagcactttcgtgctattcggcggagggaccaaactgaccgtcctag

SEQ ID NO: 8495 - DNA, 331 bp, Artificial Sequence
  Synthetic construct
cagtctgccctgactcagcctgcctccgtgtctgggtctcctggacagtcggtcaccatctcctgcactggaaccagcagtgacgttggtggttataactctgtctcctggtaccagcaacacccaggcaaagcccccaaactcatgatttatgaggtccgtaatcggcccttaggggtttctaatcgcttctctggctccaagtctggcaacacggcctccctgaccatctctgggctccggactgaggacgaggctgattattattgctgttcatattcaggcaggaacaacgatgtcttcggaactgggaccaaggtcaccgtcctgg

SEQ ID NO: 8496 - DNA, 331 bp, Artificial Sequence
  Synthetic construct
cagtctgtgctgactcagccaccctcagcgtctggggcccccgggcagagggtcatcgtttcttgttctggcagcagctccaacatcggaattaatactgtgaactggtaccagcaactcccaggaacggcccccaaactcgtcgtctataggaataatcagcggccctcaggggtccctgcccgattctctggctccaagtctggcgcgtccgcctccctgaccatcagtgggctccaggctgaggatgaggctgattattattgtgcagcatgggatgacagcctgaatactaatgtcttcggacctgggaccagggtctccgtcctag

SEQ ID NO: 8497 - DNA, 322 bp, Artificial Sequence
  Synthetic construct
gacatccagatgacccagtctccatcctccctgtctgcatctgtgggagacagagtcaccatcacctgccggacaagtcagagcattagcagttctttaaattggtatcagcagacaccagggaaagcccctaaactcctgatctacggtgcatccagtttgcaaagtggggtcccttcaaggttccgtggcagtggctctgggacagatttcactctcaccattaccagtctccaacctgaagattttgcaacttactactgtcagtggagttccagtgtcttggtgacgttcggccaagggaccaaggttgagatcaaac

SEQ ID NO: 8498 - DNA, 97 bp, Artificial Sequence
  Synthetic construct
ctccaggctgacgacgaggctgattattactgcacctcatatacaaacgacaccaattctcaggtattcggcggagggaccaagctgaccgtcctag

SEQ ID NO: 8499 - DNA, 322 bp, Artificial Sequence
  Synthetic construct
tcctttgagttgacacagccaccctcggtgtcagtgtctccaggacagacggccaggatcacctgctctggagatgaattgccaaagcaatatagttattggtaccagcagaaggcaggccaggcccctcttctggtaatgtataaagacagtgagaggccctcagggatccctgagcgattctctggctccagctcagggacaacagtcacgttgaccatcagcggagtccaggcagaagacgaggctgactatttctgtcagtcagcagacagcagtggcacttgggtgttcggcggagggaccaagctgaccgtccttg

SEQ ID NO: 8500 - DNA, 319 bp, Artificial Sequence
  Synthetic construct
gaaattgtgttgacacagtctccagccaccctgtctttgtctccaggggaaagagccaccctctcctgcagggccagtcagagtgttagtagtctcttagcctggttccaacaaaaacctggccaggctcccaggctcctcatctatgatgcatccaacagggccactggcatcccagccaggttcagtggcagtgggtctgggacagacttcactctcaccatcagcagtctagagcctgaagattttgcagtttattactgtcaacagcgtagcaactggtggacgttcggccaggggaccaaggtggaaatcaaac

SEQ ID NO: 8501 - DNA, 331 bp, Artificial Sequence
  Synthetic construct
cagtctgccctgactcagcctgcctccgtgtctgggtctcctgggcagtcgatcaccatttcctgcaatggatccagcggtgacgttggtggttttaactttgtctcctggtaccagcaataccctggcaaaacccccaaactcataatttatgaagtccataatcggccctcaggggtttctcatcgcttctctggctccaagtctggaaacacggcctccctgaccatctctggactccaggctgaggacgaggctgattatttctgcacctcatatacaggcatctctctctatgtcttcggaacaggaaccacggtcaccgtcctac

SEQ ID NO: 8502 - DNA, 319 bp, Artificial Sequence
  Synthetic construct
gacatccagatgacccagtctccttccaccctgtctgcatctgtaggagacagagtcaccatcacttgccgggccagtcagagtattagtaactggttggcctggtatcagcagaaaccagggaaagcccccaagctcctgatctataaggcgtctactttagaaagtggggtcccatcgaggttcagcggcagtggatctgggacagaattcactctcaccatcagcagcctgcagcctgatgattttgcaacttattactgccagcaatatagtggttattggacgttcggccaagggaccaaggtggaaatcaaac

SEQ ID NO: 8503 - DNA, 319 bp, Artificial Sequence
  Synthetic construct
gaaattgtgttgacgcagtctccaggcaccctgtctttgtctccaggggaaagagccaccctctcctgcagggccagtcagaatgtaagaagctacttggcctggtaccagcagaagcctggccaggctcccaggctcctcatctatgctgcatccaacagggccactgacatcccagacaggttcagtggcagtgggtctgggacagacttcactctcaccatcagcagactggagcctgaagattttgcagtgtatttctgtcagcaatatgatacctcagggacgttcggccaagggaccaaggtggaggtcaaac

SEQ ID NO: 8504 - DNA, 319 bp, Artificial Sequence
  Synthetic construct
tcccatgagctgacacagccaccctcggtgtcagtttccccaggagagacggccaagatcacctgctctggagatggattgccaaagcaatatgctttttggtaccagcagaagacaggccaggcccctcttttattactatataaagacaaagagaggcccccagggatccctgagcgattctctggctccagctctgggacaacagtcacattgaccatcagtggagtccaggcagaagacgaggctgactactactgtcaatcagcaaacagcagtgcctccgtcttcgggactgggaccaaggtcaccgtcctag

SEQ ID NO: 8505 - DNA, 325 bp, Artificial Sequence
  Synthetic construct
gaaattgtgttgacgcagtctccaggcaccctgtctttgtctccaggggaaagagccaccctctcctgcagggccagtcagagggttgacaggaagtacttagcctggtaccagcagaaacctggccaggctcccagcctcctcatctatagtgcatccagcagggccagtggcgtcccagacaggttcggtggcagtgggtctgggacagacttcactctcagcatcagcagactggagcctgaagattatgcagtgtattactgtcagctctatgataactcccggtacacttttggccaggggaccaagctggacatcaagc

SEQ ID NO: 8506 - DNA, 325 bp, Artificial Sequence
  Synthetic construct
gccatccagttgacccagtctccatccttcctgtctgcatctgtaggagacagagtcaccatcacttgccgggccagtcgggccattgacaattatttagcctggtatcagcaaaaaccaggggaagcccctaaactcctgctctatgctgtatccactttgcagagtggggtcccatcaaggttcagcggcagtggatctgggacagaattcactctcacgatcagcagcctgcagcctgaagactatgcaacttattactgtcaacagcttagttcttaccctccgatcaccttcggccaagggacacgactggagattaaac

SEQ ID NO: 8507 - DNA, 331 bp, Artificial Sequence
  Synthetic construct
cagtctgtgttgacgcagccgccctcagtgtctgcggccccaggacagaaggtcaccatgtcctgctctggaaggaactccaacattgggaataattatgtttcctggtaccagcaggtcccaggaacagcccccaaactcctcatctatgagaataataagcgaccctcagggattcctgaccgattctctggctccaagtctggcacgtcagccaccctgggcatcagcggactccagactggggacgaggccgattattactgcggaacatgggataccagcctgagtggtgtggttttcggcggcgggaccaagttgaccgtcctgg

SEQ ID NO: 8508 - DNA, 322 bp, Artificial Sequence
  Synthetic construct
gacatccagatgacccagtctccatctttcctgtctgcatctgtgggggacagagtcaccatcacttgccgggcaagtcagggcattgaaaatgatttaggctggtttcagcagaaaccagggaaagcccctaagcgcctgatctatgcagcatccaccttacagcgtggagtcccatcacggttcagcggcagtgcatctgggacagacttcactctcacaatcagcagcctgcagcctgaagattttgcaacttattattgtctacagtataataattaccctcgcacgttcggccaggggaccaaggtggaagtcagac

SEQ ID NO: 8509 - DNA, 334 bp, Artificial Sequence
  Synthetic construct
cagtctgccctgactcagcctgcctccgtgtctgggtctcctggacagtcgatcaccctctcctgcactgggaccagaagtgatattgggacttataaccttgtctcctggtaccaacagcacccaggcaaagcccccaaactcttaatttatgcgggcagacagcggccctcaggggtttctaatcgcttctctggctccaagtctggcaacacggcctccctgacaatctctgggctccaggctgaggacgaggctgattattactgctgttcatatgcaggtagtagccctaattatgtcttcggaactgggaccaaggtcaccgtcctag

SEQ ID NO: 8510 - DNA, 325 bp, Artificial Sequence; identical to SEQ ID NO: 1834
  Synthetic construct

SEQ ID NO: 8511 - DNA, 325 bp, Artificial Sequence
  Synthetic construct
tcctatgttgtgactcagccaccctcggtgtcggtggccccaggacagacggccatgattccctgtggggcatacaatattggaggtaaaactgtgcattggtaccaactgaagccaggccaggcccctgtgctggtcgtccatgatgataaacaccggccctctgggatccctgaccgattctctggctccaactctgacaacgcggccaccctgaccgtcaacagggtcgaagccggggatgaggccgactattattgtcacctgtgggatagtagtagtggtcgctgggtgtttggcggagggaccaagttgaccgtcctag

SEQ ID NO: 8512 - DNA, 328 bp, Artificial Sequence
  Synthetic construct
gagattgttttgacgcagtctccaggcaccctgtctttgtctccaggggaacgagccaccctctcttgcacggccagtcagtatttttccagcaactacttagcctggtaccagcacaaacctggccaacctccccggctcctcatttatggtgtctccagtcgggccacgggcatcccagacaggttccttggcagtgggtctgggacagacttcactctcaccatcagcagactggagcctgaagattttgcagtgtattactgtcagcactatggagactcagcggcgtacacttttggccaggggaccaagctggagatcaaac

SEQ ID NO: 8513 - DNA, 322 bp, Artificial Sequence
  Synthetic construct
gacatccagatgacccagtctccctcttccctgtctgcatctgtgggagacagagtcaccatcacttgccgggcgagtgagaacattagaaactggttagcctggtatcaacagagaccagggaaagcccctaaactcctgatctatgctgcgtccaggttgcaaagtggggtcccatcaaggttcagcggcagtggatctgggacagatttcactctcaccatcagcagcctgcagcctgacgattttgcaaattactattgtcaacaggctgacactttcccattcaatttcggccctgggaccaaagtggatatcaacc

SEQ ID NO: 8514 - DNA, 325 bp, Artificial Sequence
  Synthetic construct
gagattgtgttgactcagtctccaggcaccctgtctttgtctccaggggaaacagccaccctctcctgcagggccagtcagagtcttagcagcgacttcctagcctggtaccagcagaaacctggccaggctcccaggctcctcatgtatggtacatccagtagggccactggcatctcagacaggttcagtggcagtgggtctgggacagacttcactctcaccatcagcagactggagcctgaggattttgcagtgtattactgtcagcagtatgctagttcacctcggacgttcggccaagggaccaaggtggaaatcaaac

SEQ ID NO: 8515 - DNA, 322 bp, Artificial Sequence
  Synthetic construct
gaaattgtgttgacgcagtctccaggcaccctgtctttgtctccaggggaaagagccaccctctcctgcagggccagtcagagtgttagcgagaccaatttagcctggtaccagcagaaacctggccaggctcccaggctcctcatctatggtgcatccagcagggccactggcatcccagacaggttcagtggcagtgggtccgggacagacttcattctctccatcagcagactggagcctgaagattttgcagtgtattactgtcaacaatatggtagtacactcactttcggcggagggaccaaggtggagatcaagc

SEQ ID NO: 8516 - DNA, 328 bp, Artificial Sequence
  Synthetic construct
tcctctgtgctgactcagccaccctcggtgtcagtgccccccggacagacggccaggattacctgtgggggaagcaccattggaggtgccactgtgcactggtaccagcagaagccaggccaggccccagtgctggtcgtctatgatgatagcgaccggccctcagacatccctgagcgattctcgggctccaactctgggaacacggccaccctgaccatcagcagggtcgaggccggggatgaggccgactattactgtcaggtgtgggatagtagttctgctcatgtttatgtcttcggacctgggacgaagctcaccgtcctag

SEQ ID NO: 8517 - DNA, 334 bp, Artificial Sequence
  Synthetic construct
cagtctgccctgactcaacctgcctccgtgtctgggtctcctgaacagtcgatcaccatcgcctgcaccggaagcagcaatgatattgggagttataatcttgtgtcctggttccaacagaagccagacaaagcccccagactcataatttatgaggtccgtaagcggccctcaggggtttctaatcgcttctctggctccaagtctgacaacacggccttcctgacaatctctgaaatacaggctgaggacgaggctgaatattattgctgctcatatgcaggtagcagtcttcattatgtcttcggaactgggaccaaggtcaccgtcatgg

SEQ ID NO: 8518 - DNA, 331 bp, Artificial Sequence
  Synthetic construct
cagtctgtgctgacgcagccgccctcagtgtctggggccccagggcagaaggtcaccatctcctgcactgggagcagctccaacatcggggcaggttatgatgtacactggtaccagcagcgtccaggaacagtccccaaactcctcatctatggtaacaacaatcggccctcaggggtccctgaccgattctctggctccaagtctgacgcctcagcctccctggtcatcactgggctccaggctgaggatgaggctgattatttctgccagtcctatgacaccagcctgagtggtgtcttcggaactggaaccaaggtcaccgtcctag

SEQ ID NO: 8519 - DNA, 319 bp, Artificial Sequence
  Synthetic construct
aacgtccagatgacccagtctccttccaccctgtctgcatctgtaggagacagagtcaccatcacttgccgggccagtcagagtattagtacctggttggcctggtatcagcagaaaccagggaaagcccctaagctcctgatctatagggcatctaatttagaaactgggatcccatcaaggttcagcggcagtggatctgggacagacttcactctcaccatcagcagcctgcagcctgatgattttgcaacttattactgccaacaatataatagttattgcagttttggccaggggaccaggttggagatcaaac

SEQ ID NO: 8520 - DNA, 36 bp, Artificial Sequence
  Synthetic construct
tgtcagcagtatggtaggtcaccccagatcaccttc

SEQ ID NO: 8521 - DNA, 33 bp, Artificial Sequence
  Synthetic construct
tgccaacaatataagagtttttcttatactttt

SEQ ID NO: 8522 - DNA, 39 bp, Artificial Sequence
  Synthetic construct
tgcagctcatacagaagcagcaggattctttatgtcttc

SEQ ID NO: 8523 - DNA, 33 bp, Artificial Sequence
  Synthetic construct
tgtcagcaatatcatatgacccctccgacgttc

SEQ ID NO: 8524 - DNA, 30 bp, Artificial Sequence
  Synthetic construct
tgtcagcagtttggcagctcacccactttc

SEQ ID NO: 8525 - DNA, 39 bp, Artificial Sequence
  Synthetic construct
tgtcagcattatggtacctcacctccgatgtacaccttt

SEQ ID NO: 8526 - DNA, 33 bp, Artificial Sequence
  Synthetic construct
tgcttgctctcccatagtggtgcttgggtgttc

SEQ ID NO: 8527 - DNA, 36 bp, Artificial Sequence
  Synthetic construct
tgttcctcatatgcaggctcttacacttgggtgttc

SEQ ID NO: 8528 - DNA, 33 bp, Artificial Sequence
  Synthetic construct
tgtcagcagtatgatggctcacctcagacgttc

SEQ ID NO: 8529 - DNA, 33 bp, Artificial Sequence
  Synthetic construct
tgccaacagtatgatagttttccatacactttt

SEQ ID NO: 8530 - DNA, 42 bp, Artificial Sequence
  Synthetic construct
tgcagctcatatacaaacaacaacactcctcgttgggtgttc

SEQ ID NO: 8531 - DNA, 33 bp, Artificial Sequence
  Synthetic construct
tgtcagcaatattttgttcctcccctcactttc

SEQ ID NO: 8532 - DNA, 39 bp, Artificial Sequence
  Synthetic construct
tgtcaatcaacagacagtagtggtgattattggctgttc

SEQ ID NO: 8533 - DNA, 39 bp, Artificial Sequence
  Synthetic construct
tgcacctcatatacaaacaacagcaattctcaggtattc

SEQ ID NO: 8534 - DNA, 30 bp, Artificial Sequence
  Synthetic construct
tgtcagcagcgcagcaactggatcaccttc

SEQ ID NO: 8535 - DNA, 33 bp, Artificial Sequence
  Synthetic construct
tgtcagcaatattatagtactcctcccacgttc

SEQ ID NO: 8536 - DNA, 33 bp, Artificial Sequence
  Synthetic construct
tgtcagcagtatggtccctcactttgcaccttc

SEQ ID NO: 8537 - DNA, 39 bp, Artificial Sequence
  Synthetic construct
tgcacctcatatacaaacaacagcaattctcagatattc

SEQ ID NO: 8538 - DNA, 33 bp, Artificial Sequence
  Synthetic construct
tgtcagcaatattatagtgctcctttcactttc

SEQ ID NO: 8539 - DNA, 39 bp, Artificial Sequence
  Synthetic construct
tgccagtcctatgacagcaggctgactacttgggtgttc

SEQ ID NO: 8540 - DNA, 36 bp, Artificial Sequence
  Synthetic construct
tgcagctcatatgcaggcaacaacaattatctcttc

SEQ ID NO: 8541 - DNA, 33 bp, Artificial Sequence
  Synthetic construct
tgtcagcaatattatacttctacgtggacgttc

SEQ ID NO: 8542 - DNA, 39 bp, Artificial Sequence
  Synthetic construct
tgtaattcccgcgacagcagtggtgaccgttatgtcttc

SEQ ID NO: 8543 - DNA, 36 bp, Artificial Sequence
  Synthetic construct
tgtcactcttatgatagcgccaatccagggatattc

SEQ ID NO: 8544 - DNA, 33 bp, Artificial Sequence
  Synthetic construct
tgtctacaacattattctactcctcagactttt

SEQ ID NO: 8545 - DNA, 33 bp, Artificial Sequence
  Synthetic construct
tgccatcagagtagtgccttaattcaaactttt

SEQ ID NO: 8546 - DNA, 33 bp, Artificial Sequence
  Synthetic construct
tgtcagcactatggtagctcattgtggacgttc

SEQ ID NO: 8547 - DNA, 39 bp, Artificial Sequence
  Synthetic construct
tgtcagcagtatggcagctcacctcccccgtacactttt

SEQ ID NO: 8548 - DNA, 30 bp, Artificial Sequence
  Synthetic construct
tgtcagcagtatggtggctcacccactttc

SEQ ID NO: 8549 - DNA, 33 bp, Artificial Sequence
  Synthetic construct
tgtcagcagtacggtagttcagtgtggacgttc

SEQ ID NO: 8550 - DNA, 39 bp, Artificial Sequence
  Synthetic construct
tgtcaggtgtgggatagcagtagtgatcatgtggcattc

SEQ ID NO: 8551 - DNA, 42 bp, Artificial Sequence
  Synthetic construct
tgttcagcatgggatgaaagtctgaatggtcatgtgatattc

SEQ ID NO: 8552 - DNA, 30 bp, Artificial Sequence
  Synthetic construct
tgtcaacagagcttcagtagtgtcaccttc

SEQ ID NO: 8553 - DNA, 39 bp, Artificial Sequence
  Synthetic construct
tgctgctcaaatgcaggttgtaggacttggggtgtcttc

SEQ ID NO: 8554 - DNA, 33 bp, Artificial Sequence
  Synthetic construct
tgcatgcaaggtatataccttccgctcactttc

SEQ ID NO: 8555 - DNA, 33 bp, Artificial Sequence
  Synthetic construct
tgtcaacagcttaatagtaacccattcactttc

SEQ ID NO: 8556 - DNA, 30 bp, Artificial Sequence
  Synthetic construct
tgtcaacagtattatagttacccctttttc

SEQ ID NO: 8557 - DNA, 33 bp, Artificial Sequence
  Synthetic construct
tgtcaacagtattatagttacccgtggacgttc

SEQ ID NO: 8558 - DNA, 36 bp, Artificial Sequence
  Synthetic construct
tgtcagtcatcagacagcagtggtaattttgtcttc

SEQ ID NO: 8559 - DNA, 42 bp, Artificial Sequence
  Synthetic construct
tgtgcagcatgggatgacagcctgggtggtggggatgtcttc

SEQ ID NO: 8560 - DNA, 39 bp, Artificial Sequence
  Synthetic construct
tgcctacagtataatagttcttcttcaacatacactttt

SEQ ID NO: 8561 - DNA, 36 bp, Artificial Sequence
  Synthetic construct
tgctgctcgtatgcagggactagcactttcgtgttc

SEQ ID NO: 8562 - DNA, 33 bp, Artificial Sequence
  Synthetic construct
tgtgaacaggctaacagtttcccgctcactttc

SEQ ID NO: 8563 - DNA, 45 bp, Artificial Sequence
  Synthetic construct
tgtggggcagaccatgacagtgggagcaacttcgtttatgtcttc

SEQ ID NO: 8564 - DNA, 33 bp, Artificial Sequence
  Synthetic construct
tgtcaacaacttaatggttaccctccaactttt

SEQ ID NO: 8565 - DNA, 33 bp, Artificial Sequence
  Synthetic construct
tgtcaccagtatagtacctcaccgtggacgttc

SEQ ID NO: 8566 - DNA, 33 bp, Artificial Sequence
  Synthetic construct
tgtcaccaatattataatattcctcgaacattc

SEQ ID NO: 8567 - DNA, 30 bp, Artificial Sequence
  Synthetic construct
tgtcaccaatattatagtactctcactttc

SEQ ID NO: 8568 - DNA, 30 bp, Artificial Sequence
  Synthetic construct
tgcatgcaaggtacacacctttacaccttt

SEQ ID NO: 8569 - DNA, 33 bp, Artificial Sequence; identical to SEQ ID NO: 1838
  Synthetic construct

SEQ ID NO: 8570 - DNA, 39 bp, Artificial Sequence
  Synthetic construct
tgcagctcatatagacgtgacatcgccctttatgtcttc

SEQ ID NO: 8571 - DNA, 39 bp, Artificial Sequence
  Synthetic construct
tgcacctcatatacaaacgacagcaattctcaggtattc

SEQ ID NO: 8572 - DNA, 39 bp, Artificial Sequence
  Synthetic construct
tgctgttcgtatgcaagtagtagcactttcgtgattttc

SEQ ID NO: 8573 - DNA, 39 bp, Artificial Sequence
  Synthetic construct
tgtcaggtgtgggatagtagtagtgatcattatgtcttc

SEQ ID NO: 8574 - DNA, 36 bp, Artificial Sequence
  Synthetic construct
tgtcaccagcggagcagctggcctccgtacacttat

SEQ ID NO: 8575 - DNA, 33 bp, Artificial Sequence
  Synthetic construct
tgcatgcagggtacacactggcctcggacgttc

SEQ ID NO: 8576 - DNA, 33 bp, Artificial Sequence
  Synthetic construct
tgtcagcaatataataactggccgtacactttt

SEQ ID NO: 8577 - DNA, 33 bp, Artificial Sequence
  Synthetic construct
tgtcagacctgggacactggcgttcgcctgttc

SEQ ID NO: 8578 - DNA, 42 bp, Artificial Sequence
  Synthetic construct
tgccagtcctatgacttcagcctgagtggttcggatgtcttc

SEQ ID NO: 8579 - DNA, 33 bp, Artificial Sequence
  Synthetic construct
tgtcaacagtatggtacttcacctgtcactttt

SEQ ID NO: 8580 - DNA, 36 bp, Artificial Sequence
  Synthetic construct
tgtgagcaacgtattagctggcctggaatcaccttc

SEQ ID NO: 8581 - DNA, 33 bp, Artificial Sequence
  Synthetic construct
tgtcagcagtacggttattcacggtggacattc

SEQ ID NO: 8582 - DNA, 33 bp, Artificial Sequence
  Synthetic construct
tgcatgcaaggtacacactggcctccggggttc

SEQ ID NO: 8583 - DNA, 36 bp, Artificial Sequence
  Synthetic construct
tgctgctcatatgcagctagtagagttaaggtgttc

SEQ ID NO: 8584 - DNA, 33 bp, Artificial Sequence
  Synthetic construct
tgtcaccaatattatactcctccattcactttc

SEQ ID NO: 8585 - DNA, 36 bp, Artificial Sequence
  Synthetic construct
tgtctccaccgtaacaactggcctcccttcactttc

SEQ ID NO: 8586 - DNA, 36 bp, Artificial Sequence
  Synthetic construct
tgcttgctctcctatagtggtgctcattatgtcttc

SEQ ID NO: 8587 - DNA, 33 bp, Artificial Sequence
  Synthetic construct
tgtctacagcatgatagttaccccctcactttc

SEQ ID NO: 8588 - DNA, 33 bp, Artificial Sequence
  Synthetic construct
tgtctgcagcatattacctggccttggacattc

SEQ ID NO: 8589 - DNA, 36 bp, Artificial Sequence
  Synthetic construct
tgcatgcaaggtacagactggcccccgtacactttt

SEQ ID NO: 8590 - DNA, 36 bp, Artificial Sequence
  Synthetic construct
tgcatgcaaggtacacactggcctccggtgacgttc

SEQ ID NO: 8591 - DNA, 33 bp, Artificial Sequence
  Synthetic construct
tgtcagcactatgatcatctcccgtggaccttc

SEQ ID NO: 8592 - DNA, 33 bp, Artificial Sequence
  Synthetic construct
tgtcaacagtgtgatgatctcccgtacactttt

SEQ ID NO: 8593 - DNA, 33 bp, Artificial Sequence
  Synthetic construct
tgtcaacagttttatggtgccccattcactttc

SEQ ID NO: 8594 - DNA, 33 bp, Artificial Sequence
  Synthetic construct
tgtcagcagcgcagcaactggcctctcactttc

SEQ ID NO: 8595 - DNA, 33 bp, Artificial Sequence
  Synthetic construct
tgtcaacagagttacgcctccccgactacgttt

SEQ ID NO: 8596 - DNA, 33 bp, Artificial Sequence
  Synthetic construct
tgtcaacagagttacagaattcctcacaccttt

SEQ ID NO: 8597 - DNA, 33 bp, Artificial Sequence
  Synthetic construct
tgtcaacagagttacagtaccccgctcactttc

SEQ ID NO: 8598 - DNA, 30 bp, Artificial Sequence
  Synthetic construct
tgtcaacagacttacaatacgatcactttc

SEQ ID NO: 8599 - DNA, 33 bp, Artificial Sequence
  Synthetic construct
tgtcaacaatatgatagtctcccggtcactttc

SEQ ID NO: 8600 - DNA, 33 bp, Artificial Sequence
  Synthetic construct
tgtcaacaatatggtagctccctgtacagtttt

SEQ ID NO: 8601 - DNA, 33 bp, Artificial Sequence
  Synthetic construct
tgtcagcagtatggtagctcaccgctcactttc

SEQ ID NO: 8602 - DNA, 39 bp, Artificial Sequence
  Synthetic construct
tgtcagcagtatggtagctcacctccgcggttcactttc

SEQ ID NO: 8603 - DNA, 33 bp, Artificial Sequence
  Synthetic construct
tgtcagcagtacggctatctgccactgactttt

SEQ ID NO: 8604 - DNA, 33 bp, Artificial Sequence
  Synthetic construct
tgccaacagtataatgcttacccattcactttc

SEQ ID NO: 8605 - DNA, 36 bp, Artificial Sequence
  Synthetic construct
tgtcagcagtataatcattggctccctctcactttc

SEQ ID NO: 8606 - DNA, 36 bp, Artificial Sequence
  Synthetic construct
tgtcagcaatataataagtggcctccgtggacgttc

SEQ ID NO: 8607 - DNA, 36 bp, Artificial Sequence
  Synthetic construct
tgtcagcagtataataactggcccccattcactttc

SEQ ID NO: 8608 - DNA, 33 bp, Artificial Sequence
  Synthetic construct
tgtcagcagtataatagctggccatttactttc

SEQ ID NO: 8609 - DNA, 30 bp, Artificial Sequence
  Synthetic construct
tgccaacagtataatagttattggacgttc

SEQ ID NO: 8610 - DNA, 36 bp, Artificial Sequence
  Synthetic construct
tgtcagcaatataatgtctggcctacgatcaccttc

SEQ ID NO: 8611 - DNA, 33 bp, Artificial Sequence
  Synthetic construct
tgtcagcagtatcgtagctcaccattcactttc

SEQ ID NO: 8612 - DNA, 33 bp, Artificial Sequence
  Synthetic construct
tgtcagcagtatcgttactcaccgaggacgttc

SEQ ID NO: 8613 - DNA, 30 bp, Artificial Sequence
  Synthetic construct
tgtcagcaatattctagtttcgggactttc

SEQ ID NO: 8614 - DNA, 33 bp, Artificial Sequence
  Synthetic construct
tgtcagcaatattataatactccgtacactttt

SEQ ID NO: 8615 - DNA, 33 bp, Artificial Sequence
  Synthetic construct
tgtcaacagtattatagtttccctcgaacgttc

SEQ ID NO: 8616 - DNA, 33 bp, Artificial Sequence
  Synthetic construct
tgtcagcaatattatagtactccgtacactttt

SEQ ID NO: 8617 - DNA, 33 bp, Artificial Sequence
  Synthetic construct
tgtcaacagtattatagttaccctctaacgttc

SEQ ID NO: 8618 - DNA, 33 bp, Artificial Sequence
  Synthetic construct
tgtcaacagtattatactattccgcggacgttc

SEQ ID NO: 8619 - DNA, 39 bp, Artificial Sequence
  Synthetic construct
tgtcaatcagcagacagcggtggtacttctgtgacattc

SEQ ID NO: 8620 - DNA, 39 bp, Artificial Sequence
  Synthetic construct
tgtcagtcccgggacagcagtggtaaccagctggtgttc

SEQ ID NO: 8621 - DNA, 36 bp, Artificial Sequence
  Synthetic construct
tgtcaatcagtagacagaagtggttctcatgtcttc

SEQ ID NO: 8622 - DNA, 39 bp, Artificial Sequence
  Synthetic construct
tgtcaggtgtgggatagtagtagtgatcattgggtgttc

SEQ ID NO: 8623 - DNA, 39 bp, Artificial Sequence
  Synthetic construct
tgcacctcatatacaaacgacagcaattctcaggcattc

SEQ ID NO: 8624 - DNA, 39 bp, Artificial Sequence
  Synthetic construct
tgcacctcatatacaaacgacagcaattctcagctattc

SEQ ID NO: 8625 - DNA, 39 bp, Artificial Sequence
  Synthetic construct
tgcacctcatatacaaacgacaccaattctcaggtattc

SEQ ID NO: 8626 - DNA, 39 bp, Artificial Sequence
  Synthetic construct
tgcacctcatatacaaacaacaacaattctcaggtattc

SEQ ID NO: 8627 - DNA, 39 bp, Artificial Sequence
  Synthetic construct
tgcacctcatatacaaacaacagcaattctcatgtattc

SEQ ID NO: 8628 - DNA, 39 bp, Artificial Sequence
  Synthetic construct
tgcacctcatatacaaacaacagcaattcccaggtattc

SEQ ID NO: 8629 - DNA, 33 bp, Artificial Sequence
  Synthetic construct
tgtcaacactatgatcatctccctctcactttc

SEQ ID NO: 8630 - DNA, 33 bp, Artificial Sequence
  Synthetic construct
tgtcagcagtatggtagctcaccgtggacgttc

SEQ ID NO: 8631 - DNA, 33 bp, Artificial Sequence
  Synthetic construct
tgtcagcagtattatagtacttcgtggacgttc

SEQ ID NO: 8632 - DNA, 30 bp, Artificial Sequence
  Synthetic construct
tgtcagcaatatggtaattcagggacgttc

SEQ ID NO: 8633 - DNA, 30 bp, Artificial Sequence
  Synthetic construct
tgtcagcagtatggtggctcatccaccttc

SEQ ID NO: 8634 - DNA, 36 bp, Artificial Sequence
  Synthetic construct
tgtcagcagcgtagcaactggccttcgctcactttc

SEQ ID NO: 8635 - DNA, 42 bp, Artificial Sequence
  Synthetic construct
tgtaactcccgggacagcagtggtaaccatctgggggtcttc

SEQ ID NO: 8636 - DNA, 39 bp, Artificial Sequence
  Synthetic construct
tgtcaggtgtgggatagtagtagtgatcatgtggtattc

SEQ ID NO: 8637 - DNA, 33 bp, Artificial Sequence
  Synthetic construct
tgtcagcagtataagagctggcccctcgcgttc

SEQ ID NO: 8638 - DNA, 39 bp, Artificial Sequence
  Synthetic construct
tgtgcagcgtgggatgacaccctgagtgcttgggtgttc

SEQ ID NO: 8639 - DNA, 33 bp, Artificial Sequence
  Synthetic construct
tgtcagcagtatggtagctcacctcaaacgttc

SEQ ID NO: 8640 - DNA, 36 bp, Artificial Sequence
  Synthetic construct
tgtcagcagcgtagcaactggcctccgtggacgttc

SEQ ID NO: 8641 - DNA, 33 bp, Artificial Sequence
  Synthetic construct
tgcatgcaacgtatagagtttccgtggacgttc

SEQ ID NO: 8642 - DNA, 42 bp, Artificial Sequence
  Synthetic construct
tgtgcagcatgggatgacagcctgagtggtcggggggtattc

SEQ ID NO: 8643 - DNA, 33 bp, Artificial Sequence
  Synthetic construct
tgtcaacagagttacagtaccccgtacactttt

SEQ ID NO: 8644 - DNA, 36 bp, Artificial Sequence
  Synthetic construct
tgctgctcatatgcaggcagctacacttgggtgttc

SEQ ID NO: 8645 - DNA, 33 bp, Artificial Sequence
  Synthetic construct
tgtgtacaggattacgattaccctcatacattc

SEQ ID NO: 8646 - DNA, 39 bp, Artificial Sequence
  Synthetic construct
tgcacctcatatacaaacgacagcaattctcaggtcttc

SEQ ID NO: 8647 - DNA, 39 bp, Artificial Sequence
  Synthetic construct
tgtcaatcagtaggcactaatcatctttctgtggtcttc

SEQ ID NO: 8648 - DNA, 39 bp, Artificial Sequence
  Synthetic construct
tgcacctcatatgcaggcagcaacaatttcagggtcttc

SEQ ID NO: 8649 - DNA, 39 bp, Artificial Sequence
  Synthetic construct
tgcgccgcttgggatgaccacctgcgaattgtgggtttc

SEQ ID NO: 8650 - DNA, 39 bp, Artificial Sequence
  Synthetic construct
tgtcaatcttatgataccaccacggatcatgcagtcttc

SEQ ID NO: 8651 - DNA, 33 bp, Artificial Sequence
  Synthetic construct
tgtcaacagtatcatagtaccccgtggacgttc

SEQ ID NO: 8652 - DNA, 33 bp, Artificial Sequence
  Synthetic construct
tgtctacaacataatagttaccctcgaacgttc

SEQ ID NO: 8653 - DNA, 33 bp, Artificial Sequence
  Synthetic construct
tgccaacagtatagtactgattcggcgacgttc

SEQ ID NO: 8654 - DNA, 42 bp, Artificial Sequence
  Synthetic construct
tgccagtcctatgacagtagcctgagtgattcgaaagtattc

SEQ ID NO: 8655 - DNA, 33 bp, Artificial Sequence
  Synthetic construct
tgtcagcaatcttatactagtcctgtcactttc

SEQ ID NO: 8656 - DNA, 33 bp, Artificial Sequence
  Synthetic construct
tgtcagcagtatgcttcctcaccggtcactttc

SEQ ID NO: 8657 - DNA, 33 bp, Artificial Sequence
  Synthetic construct
tgccaacactgtgatagttatccgtggacgttc

SEQ ID NO: 8658 - DNA, 33 bp, Artificial Sequence
  Synthetic construct
tgttactctgcggctgacaacaatcgagtcttc

SEQ ID NO: 8659 - DNA, 39 bp, Artificial Sequence
  Synthetic construct
tgtcaggcgtgggatgttgatagtgatcaaatggttttc

SEQ ID NO: 8660 - DNA, 30 bp, Artificial Sequence
  Synthetic construct
tgtcagcagtatgctacctcaccgactttt

SEQ ID NO: 8661 - DNA, 36 bp, Artificial Sequence
  Synthetic construct
tgtcagcagtattataactggcctccgcacactttt

SEQ ID NO: 8662 - DNA, 33 bp, Artificial Sequence
  Synthetic construct
tgtctgcggtgtaacggtttccctctcactttc

SEQ ID NO: 8663 - DNA, 36 bp, Artificial Sequence
  Synthetic construct
tgtcagcactatcctatgtcacctccgatcaccttc

SEQ ID NO: 8664 - DNA, 30 bp, Artificial Sequence
  Synthetic construct
tgccaacagtatcagagttattcgactttc

SEQ ID NO: 8665 - DNA, 39 bp, Artificial Sequence
  Synthetic construct
tgtgcagcatgggatgacaccctgcatggtgtggttttc

SEQ ID NO: 8666 - DNA, 33 bp, Artificial Sequence
  Synthetic construct
tgttactctgcggctgacaagagtctggtattc

SEQ ID NO: 8667 - DNA, 42 bp, Artificial Sequence
  Synthetic construct
tgtcaatccgcagacagtagtggttcttatcctgtggttttc

SEQ ID NO: 8668 - DNA, 36 bp, Artificial Sequence
  Synthetic construct
tgcagctcattggaaggcaggaacaattgggtgttc

SEQ ID NO: 8669 - DNA, 33 bp, Artificial Sequence
  Synthetic construct
tgtcaacagtataagagttacaagtggacgttc

SEQ ID NO: 8670 - DNA, 42 bp, Artificial Sequence
  Synthetic construct
tgccagtcctttgacaacagtgtgggtgtccaagtgattttc

SEQ ID NO: 8671 - DNA, 33 bp, Artificial Sequence
  Synthetic construct
tgcatgcagcatctaaaaattcctcggactttt

SEQ ID NO: 8672 - DNA, 39 bp, Artificial Sequence
  Synthetic construct
tgtcagcagtatagtggctcacttcccccatacactttt

SEQ ID NO: 8673 - DNA, 33 bp, Artificial Sequence
  Synthetic construct
tgtcagtcttatgatggcagcaatcagttattc

SEQ ID NO: 8674 - DNA, 39 bp, Artificial Sequence
  Synthetic construct
tgccaacagtataatacttactctcccacgtgggcattc

SEQ ID NO: 8675 - DNA, 33 bp, Artificial Sequence
  Synthetic construct
tgccaacactataatagttacccgtacactttt

SEQ ID NO: 8676 - DNA, 36 bp, Artificial Sequence
  Synthetic construct
tgtcaggcgtgggacagcaacacttttgtgatgttc

SEQ ID NO: 8677 - DNA, 36 bp, Artificial Sequence
  Synthetic construct
tgtcaacaatataatgactggcctccggtcactttc

SEQ ID NO: 8678 - DNA, 30 bp, Artificial Sequence
  Synthetic construct
tgtcagcaatatggtagctcacccactttc

SEQ ID NO: 8679 - DNA, 33 bp, Artificial Sequence
  Synthetic construct
tgtcagcagtattttcgtagtcctcacacgttc

SEQ ID NO: 8680 - DNA, 33 bp, Artificial Sequence
  Synthetic construct
tgcatgcaagggacacactggcctctgactttt

SEQ ID NO: 8681 - DNA, 33 bp, Artificial Sequence
  Synthetic construct
tgtcaacagtataatagtctcccgtggacgttc

SEQ ID NO: 8682 - DNA, 36 bp, Artificial Sequence
  Synthetic construct
tgtcagcaatttggtggctcccctctgtacactttt

SEQ ID NO: 8683 - DNA, 36 bp, Artificial Sequence
  Synthetic construct
tgtcagcagtattatgactggcctccgtggacgttc

SEQ ID NO: 8684 - DNA, 42 bp, Artificial Sequence
  Synthetic construct
tgtgttgcatgggatgtcaatctgagtggtcctgtgctcatc

SEQ ID NO: 8685 - DNA, 36 bp, Artificial Sequence
  Synthetic construct
tgtcaacagagttacagtaccctcgcggtcactttc

SEQ ID NO: 8686 - DNA, 36 bp, Artificial Sequence
  Synthetic construct
tgtcttctctatatgggtactggctcttgggtgttc

SEQ ID NO: 8687 - DNA, 33 bp, Artificial Sequence
  Synthetic construct
tgtcagcagtatgttagttcacccctgacgttc

SEQ ID NO: 8688 - DNA, 33 bp, Artificial Sequence
  Synthetic construct
tgtcaccagtatggtagttcagcgaggactttt

SEQ ID NO: 8689 - DNA, 33 bp, Artificial Sequence
  Synthetic construct
tgccaacactatgatagatattcagcgacgttc

SEQ ID NO: 8690 - DNA, 33 bp, Artificial Sequence
  Synthetic construct
tgtcaacagtatggcagttcgcctcagacgttc

SEQ ID NO: 8691 - DNA, 30 bp, Artificial Sequence
  Synthetic construct
tgtcatcagagtagtagttggtacactttt

SEQ ID NO: 8692 - DNA, 39 bp, Artificial Sequence
  Synthetic construct
tgtcagcagcggagcaatgggcgtccgagggtcactttc

SEQ ID NO: 8693 - DNA, 33 bp, Artificial Sequence
  Synthetic construct
tgtctacaagattacaattacccctggaagttc

SEQ ID NO: 8694 - DNA, 33 bp, Artificial Sequence
  Synthetic construct
tgtcaacagagttacagtaccccgtggacgttc

SEQ ID NO: 8695 - DNA, 30 bp, Artificial Sequence
  Synthetic construct
tgtcagcagtatggtagctcaccaacgttc

SEQ ID NO: 8696 - DNA, 33 bp, Artificial Sequence
  Synthetic construct
tgcatgcaagctacacaatttcctcagacgttc

SEQ ID NO: 8697 - DNA, 36 bp, Artificial Sequence
  Synthetic construct
tgtcagcagtataataactggcctacgtacactttt

SEQ ID NO: 8698 - DNA, 39 bp, Artificial Sequence
  Synthetic construct
tgtcaatcagcagacagcagtggtacttatgtggtattc

SEQ ID NO: 8699 - DNA, 36 bp, Artificial Sequence
  Synthetic construct
tgctgctcatatgcaggcagctacacttatgtcttc

SEQ ID NO: 8700 - DNA, 33 bp, Artificial Sequence
  Synthetic construct
tgtctacaggattacaattacccgtgggcgttc

SEQ ID NO: 8701 - DNA, 33 bp, Artificial Sequence
  Synthetic construct
tgtcagtcttatgaaaacagttattgggtgttc

SEQ ID NO: 8702 - DNA, 33 bp, Artificial Sequence
  Synthetic construct
tgtcagcaatattataactggcctcggacgttc

SEQ ID NO: 8703 - DNA, 39 bp, Artificial Sequence
  Synthetic construct
tgtcaggtgtgggatagtagtggtgatcatccggtgttc

SEQ ID NO: 8704 - DNA, 36 bp, Artificial Sequence
  Synthetic construct
tgctgctcatatgcaggcagctacactcatgtcttc

SEQ ID NO: 8705 - DNA, 36 bp, Artificial Sequence
  Synthetic construct
tgtcaggaatttcatgatactctcgggctcactttc

SEQ ID NO: 8706 - DNA, 33 bp, Artificial Sequence
  Synthetic construct
tgtcagcagacttacagtgccccatggacgttc

SEQ ID NO: 8707 - DNA, 36 bp, Artificial Sequence
  Synthetic construct
tgtcaacattatgttaactggcctccgtggacgttc

SEQ ID NO: 8708 - DNA, 33 bp, Artificial Sequence
  Synthetic construct
tgtctacaacataatagttaccctctcactttc

SEQ ID NO: 8709 - DNA, 33 bp, Artificial Sequence
  Synthetic construct
tgcatgcaggctctacagactcctcccaccttc

SEQ ID NO: 8710 - DNA, 33 bp, Artificial Sequence
  Synthetic construct
tgtcaacagagttacagcacccccttcactttc

SEQ ID NO: 8711 - DNA, 39 bp, Artificial Sequence
  Synthetic construct
tgttattcccgtgccggtactggtgaccatgtggtgttc

SEQ ID NO: 8712 - DNA, 36 bp, Artificial Sequence
  Synthetic construct
tgtcagcagcgtagcgactggccgcctctcactttc

SEQ ID NO: 8713 - DNA, 33 bp, Artificial Sequence
  Synthetic construct
tgtcagcagtataatgactggccgtggacgttc

SEQ ID NO: 8714 - DNA, 33 bp, Artificial Sequence
  Synthetic construct
tgtcaaaagtataacagtgccccgctcactttc

SEQ ID NO: 8715 - DNA, 33 bp, Artificial Sequence
  Synthetic construct
tgtcaaaactataacagtgccccattcactttc

SEQ ID NO: 8716 - DNA, 39 bp, Artificial Sequence
  Synthetic construct
tgtaactcccgggacaccagtggtaaccgttgggtgttc

SEQ ID NO: 8717 - DNA, 33 bp, Artificial Sequence
  Synthetic construct
tgtcagcagtataatgactggctgatcacgttc

SEQ ID NO: 8718 - DNA, 39 bp, Artificial Sequence
  Synthetic construct
tgtgcatcatgggatgacagcctgaatggttgggggttc

SEQ ID NO: 8719 - DNA, 36 bp, Artificial Sequence
  Synthetic construct
tgtcaggtgtgggatagtagtactgatcatctattc

SEQ ID NO: 8720 - DNA, 39 bp, Artificial Sequence
  Synthetic construct
tgtgcagtttgggatgacaacctgagggcttgggtgttc

SEQ ID NO: 8721 - DNA, 33 bp, Artificial Sequence
  Synthetic construct
tgtcaaaagtataacagtgccccattcactttc

SEQ ID NO: 8722 - DNA, 33 bp, Artificial Sequence
  Synthetic construct
tgccaacagtataatacttattcgtacactttt

SEQ ID NO: 8723 - DNA, 33 bp, Artificial Sequence
  Synthetic construct
tgccaacagtataaaagttattcgtggacgttc

SEQ ID NO: 8724 - DNA, 39 bp, Artificial Sequence
  Synthetic construct
tgtcagatttgggatattgacagtgatcattgggtgttc

SEQ ID NO: 8725 - DNA, 36 bp, Artificial Sequence
  Synthetic construct
tgctgctcatatgcaggcagttacacttttctcttc

SEQ ID NO: 8726 - DNA, 36 bp, Artificial Sequence
  Synthetic construct
tgtcaggtgtggaatagtattagtgattatgtcttc

SEQ ID NO: 8727 - DNA, 39 bp, Artificial Sequence
  Synthetic construct
tgccagtcctatgacagcagcctgagtgccgtggtattc

SEQ ID NO: 8728 - DNA, 33 bp, Artificial Sequence
  Synthetic construct
tgtcagacctggggcactggcattcaggtgttc

SEQ ID NO: 8729 - DNA, 33 bp, Artificial Sequence
  Synthetic construct
tgtcaacagtattatagttaccctccgacgttc

SEQ ID NO: 8730 - DNA, 39 bp, Artificial Sequence
  Synthetic construct
tgtcaatcagcagacagcagtggtacttatcgggtattc

SEQ ID NO: 8731 - DNA, 33 bp, Artificial Sequence
  Synthetic construct
tgtcagcaatattatagtactcttcggacgttc

SEQ ID NO: 8732 - DNA, 33 bp, Artificial Sequence
  Synthetic construct
tgcttgctctcctatagtggtgcttgggtgttc

SEQ ID NO: 8733 - DNA, 33 bp, Artificial Sequence
  Synthetic construct
tgtcaacagacttacagtgccccgtacactttt

SEQ ID NO: 8734 - DNA, 39 bp, Artificial Sequence
  Synthetic construct
tgtcaatcagcagacagcagtggtctttattatgtcttc

SEQ ID NO: 8735 - DNA, 36 bp, Artificial Sequence
  Synthetic construct
tgtcaacagagttacagtacccccctgtacactttt

SEQ ID NO: 8736 - DNA, 33 bp, Artificial Sequence
  Synthetic construct
tgtctacaagattacaattaccctcgaacgttc

SEQ ID NO: 8737 - DNA, 33 bp, Artificial Sequence
  Synthetic construct
tgtcagcagcgtagcaactggccggagactttt

SEQ ID NO: 8738 - DNA, 36 bp, Artificial Sequence
  Synthetic construct
tgtcagcagcgtagcaactggcctccgatcaccttc

SEQ ID NO: 8739 - DNA, 39 bp, Artificial Sequence
  Synthetic construct
tgtaactcccgggacagcagtggcaagcatctgctattc

SEQ ID NO: 8740 - DNA, 33 bp, Artificial Sequence
  Synthetic construct
tgtcagtcttatgatagtacttatagggtgttc

SEQ ID NO: 8741 - DNA, 42 bp, Artificial Sequence
  Synthetic construct
tgtaattcccgggacatgagtggtaaccatctgggggtcttc

SEQ ID NO: 8742 - DNA, 33 bp, Artificial Sequence
  Synthetic construct
tgccaacagtataatagttattctcagacgttc

SEQ ID NO: 8743 - DNA, 42 bp, Artificial Sequence
  Synthetic construct
tgtcaggtgtgggatagtagtagtgatcatccgggggtattc

SEQ ID NO: 8744 - DNA, 33 bp, Artificial Sequence
  Synthetic construct
tgccaacagtataatagttattctcggacgttc

SEQ ID NO: 8745 - DNA, 39 bp, Artificial Sequence
  Synthetic construct
tgtcaggcgtgggacagcagcactgccctttatgtcttc

SEQ ID NO: 8746 - DNA, 33 bp, Artificial Sequence
  Synthetic construct
tgtcaacagtattatagttacccgctcactttc

SEQ ID NO: 8747 - DNA, 33 bp, Artificial Sequence
  Synthetic construct
tgtcagcagtataataactggcctccgacgttc

SEQ ID NO: 8748 - DNA, 36 bp, Artificial Sequence
  Synthetic construct
tgtcagcagtataataactggcctccgtacactttt

SEQ ID NO: 8749 - DNA, 39 bp, Artificial Sequence
  Synthetic construct
tgtaactcccgggacagcagtggtaaccattatgtcttc

SEQ ID NO: 8750 - DNA, 33 bp, Artificial Sequence
  Synthetic construct
tgccaacagtataatagttatctattcactttc

SEQ ID NO: 8751 - DNA, 33 bp, Artificial Sequence
  Synthetic construct
tgtcaacaggccaacagtttcccgctctctttc

SEQ ID NO: 8752 - DNA, 33 bp, Artificial Sequence
  Synthetic construct
tgtcagcaccgcagcacctggcctccgacgttc

SEQ ID NO: 8753 - DNA, 21 bp, Artificial Sequence
  Synthetic construct
tgtcaacaccttaggacgttc

SEQ ID NO: 8754 - DNA, 36 bp, Artificial Sequence
  Synthetic construct
tgctgctcatatgcaggtagtagtacttatgtcttc

SEQ ID NO: 8755 - DNA, 33 bp, Artificial Sequence
  Synthetic construct
tgtcagcaatatcatagctggccgggcactttt

SEQ ID NO: 8756 - DNA, 33 bp, Artificial Sequence
  Synthetic construct
tgccatcaatataatagttatccgacaacattc

SEQ ID NO: 8757 - DNA, 33 bp, Artificial Sequence
  Synthetic construct
tgccaacactatgataattatccgtggacgttc

SEQ ID NO: 8758 - DNA, 39 bp, Artificial Sequence
  Synthetic construct
tgtcaggtgtgggataacaatagtgaacatgaagtcttc

SEQ ID NO: 8759 - DNA, 36 bp, Artificial Sequence
  Synthetic construct
tgccaacaatatgatagtcgttttccgtacactttt

SEQ ID NO: 8760 - DNA, 39 bp, Artificial Sequence
  Synthetic construct
tgtgcagcatgggatgacagcctgaatggtccggtcttc

SEQ ID NO: 8761 - DNA, 39 bp, Artificial Sequence
  Synthetic construct
tgtcagttgtataataactggcctcggagaatcactttc

SEQ ID NO: 8762 - DNA, 30 bp, Artificial Sequence
  Synthetic construct
tgccaacattataatacttatagggcgttc

SEQ ID NO: 8763 - DNA, 33 bp, Artificial Sequence
  Synthetic construct
tgtcagcaatactatactactccgtacactttt

SEQ ID NO: 8764 - DNA, 39 bp, Artificial Sequence
  Synthetic construct
tgttgcgcaatggacgtcaggagtcaccaggtgaaattc

SEQ ID NO: 8765 - DNA, 33 bp, Artificial Sequence
  Synthetic construct
tgccaacagtataatagttatctgtggacgttc

SEQ ID NO: 8766 - DNA, 36 bp, Artificial Sequence
  Synthetic construct
tgcagctcatatacaagcagcagcactcgggtcttc

SEQ ID NO: 8767 - DNA, 42 bp, Artificial Sequence
  Synthetic construct
tgtaactcctgggacaccagtggtaactatcccgtgatattc

SEQ ID NO: 8768 - DNA, 30 bp, Artificial Sequence
  Synthetic construct
tgtcaccaatatgacaccatgtacactttt

SEQ ID NO: 8769 - DNA, 42 bp, Artificial Sequence
  Synthetic construct
tgccagtcctatgacagcagcctgagtgtcttttatgtcttc

SEQ ID NO: 8770 - DNA, 39 bp, Artificial Sequence
  Synthetic construct
tgtcaggtgtgggatagtactggcgatcatgtggtcttc

SEQ ID NO: 8771 - DNA, 33 bp, Artificial Sequence
  Synthetic construct
tgtcagcagcgtggcgactggcctccgaccttc

SEQ ID NO: 8772 - DNA, 42 bp, Artificial Sequence
  Synthetic construct
tgcagctcatatacaagcagcagcactctcgatgtggtattc

SEQ ID NO: 8773 - DNA, 33 bp, Artificial Sequence
  Synthetic construct
tgcagctcatatgcaggcagctctgtggtattc

SEQ ID NO: 8774 - DNA, 30 bp, Artificial Sequence
  Synthetic construct
tgtcagcagtatggtagctcactcactttc

SEQ ID NO: 8775 - DNA, 30 bp, Artificial Sequence
  Synthetic construct
tgtcagcagtataataactggcctcgtttc

SEQ ID NO: 8776 - DNA, 33 bp, Artificial Sequence
  Synthetic construct
tgtcaacagtataataactggcctcgaacgttc

SEQ ID NO: 8777 - DNA, 39 bp, Artificial Sequence
  Synthetic construct
tgcggaacatatgatcgcagcctgagtgcttgggtgttc

SEQ ID NO: 8778 - DNA, 39 bp, Artificial Sequence
  Synthetic construct
tgcggaacatgggatgccgaattgagagcgagggtgttc

SEQ ID NO: 8779 - DNA, 45 bp, Artificial Sequence
  Synthetic construct
tgtcaggtgtgggatagcagtagtgatcctccgtgtgtggtgttc

SEQ ID NO: 8780 - DNA, 33 bp, Artificial Sequence
  Synthetic construct
tgtcaacagagttacaatatcccgtacaccttt

SEQ ID NO: 8781 - DNA, 36 bp, Artificial Sequence
  Synthetic construct
tgtcaacactatgcttactcaccaccgtggacgttc

SEQ ID NO: 8782 - DNA, 27 bp, Artificial Sequence
  Synthetic construct
tgccaacagtataatagttacactttt

SEQ ID NO: 8783 - DNA, 36 bp, Artificial Sequence
  Synthetic construct
tgcagctcatatacaaccaggattccttgtgtcttc

SEQ ID NO: 8784 - DNA, 33 bp, Artificial Sequence
  Synthetic construct
tgtgagacctgggacagttacactcaggtgttc

SEQ ID NO: 8785 - DNA, 33 bp, Artificial Sequence
  Synthetic construct
tgtcagcaatattttaattctcccatcaccttc

SEQ ID NO: 8786 - DNA, 33 bp, Artificial Sequence
  Synthetic construct
tgccaacaatataatagttacatgtacactttt

SEQ ID NO: 8787 - DNA, 33 bp, Artificial Sequence
  Synthetic construct
tgtcaaaagtataaccgtgccccccacactttt

SEQ ID NO: 8788 - DNA, 33 bp, Artificial Sequence
  Synthetic construct
tgccaacagtataatagttattcgtggacgttc

SEQ ID NO: 8789 - DNA, 33 bp, Artificial Sequence
  Synthetic construct
tgccaacagtatgatagttatcctcgaacgttc

SEQ ID NO: 8790 - DNA, 33 bp, Artificial Sequence
  Synthetic construct
tgccaacaatataatatctatccggaaacgttc

SEQ ID NO: 8791 - DNA, 36 bp, Artificial Sequence
  Synthetic construct
tgtcagcaccgtagcaactggcctccgtacactttt

SEQ ID NO: 8792 - DNA, 36 bp, Artificial Sequence
  Synthetic construct
tgcttactcgcctttggtggtgtccggtgggtgttc

SEQ ID NO: 8793 - DNA, 39 bp, Artificial Sequence
  Synthetic construct
tgccagtcctatgacagccgcctgagtggttatgtcttc

SEQ ID NO: 8794 - DNA, 30 bp, Artificial Sequence
  Synthetic construct
tgtcaacagtatgataatctgatcaccttc

SEQ ID NO: 8795 - DNA, 30 bp, Artificial Sequence
  Synthetic construct
tgccaacagtataatagttattcaactttc

SEQ ID NO: 8796 - DNA, 33 bp, Artificial Sequence
  Synthetic construct
tgccaacaatataatagtgtcttatacactttt

SEQ ID NO: 8797 - DNA, 33 bp, Artificial Sequence
  Synthetic construct
tgcatgcaaggtgcgcagtggcccccgacgttc

SEQ ID NO: 8798 - DNA, 33 bp, Artificial Sequence
  Synthetic construct
tgtcaccagtatggcagttcgcgtcagacgttc

SEQ ID NO: 8799 - DNA, 39 bp, Artificial Sequence
  Synthetic construct
tgctcctcatattcgcgcagcagcgattcttatgtcttc

SEQ ID NO: 8800 - DNA, 36 bp, Artificial Sequence
  Synthetic construct
tgtcagcaatattataccagtcctccgtatactttc

SEQ ID NO: 8801 - DNA, 30 bp, Artificial Sequence
  Synthetic construct
tgccaacaatatcaaagttattcttctttc

SEQ ID NO: 8802 - DNA, 33 bp, Artificial Sequence
  Synthetic construct
tgtcatcaatattatgactggccgtggacgttc

SEQ ID NO: 8803 - DNA, 36 bp, Artificial Sequence
  Synthetic construct
tgtcagcactataataagtggccccctttcactttc

SEQ ID NO: 8804 - DNA, 36 bp, Artificial Sequence
  Synthetic construct
tgcagctcatatacaaccagcaacactctggtattc

SEQ ID NO: 8805 - DNA, 36 bp, Artificial Sequence
  Synthetic construct
tgtcagcagtataataactggcctccgttcactttc

SEQ ID NO: 8806 - DNA, 36 bp, Artificial Sequence
  Synthetic construct
tgtcaacagagttacagtacccctcggatcactttc

SEQ ID NO: 8807 - DNA, 36 bp, Artificial Sequence
  Synthetic construct
tgtcaacagtattatagtacccctccgctcactttc

SEQ ID NO: 8808 - DNA, 33 bp, Artificial Sequence
  Synthetic construct
tgtcaacagagttacttgaacaggtggacgttc

SEQ ID NO: 8809 - DNA, 39 bp, Artificial Sequence
  Synthetic construct
tgttattcaacagacagcagtggtactcatagggtattc

SEQ ID NO: 8810 - DNA, 36 bp, Artificial Sequence
  Synthetic construct
tgtcaacaatatgaaattctgcctcggttcactttc

SEQ ID NO: 8811 - DNA, 33 bp, Artificial Sequence
  Synthetic construct
tgccaacagtataatagttaccctttcactttc

SEQ ID NO: 8812 - DNA, 36 bp, Artificial Sequence
  Synthetic construct
tgtcagcagtataagaactggcctccgaacactttt

SEQ ID NO: 8813 - DNA, 33 bp, Artificial Sequence
  Synthetic construct
tgtcagcagtatggtaactcacagatcacgttc

SEQ ID NO: 8814 - DNA, 33 bp, Artificial Sequence
  Synthetic construct
tgtcatcagagttatactttagcgaacactttt

SEQ ID NO: 8815 - DNA, 33 bp, Artificial Sequence
  Synthetic construct
tgtcaacaggctaacagtttcccaatcaccttc

SEQ ID NO: 8816 - DNA, 39 bp, Artificial Sequence
  Synthetic construct
tgtcaacagagttacagtgcccctccggtgtacagtttt

SEQ ID NO: 8817 - DNA, 33 bp, Artificial Sequence
  Synthetic construct
tgtcagcagtatggtacctcacctctgacgttc

SEQ ID NO: 8818 - DNA, 33 bp, Artificial Sequence
  Synthetic construct
tgtcagcaatattttggtactcctctcactttc

SEQ ID NO: 8819 - DNA, 30 bp, Artificial Sequence
  Synthetic construct
tgccaacagtataatagttatccgacgttc

SEQ ID NO: 8820 - DNA, 36 bp, Artificial Sequence
  Synthetic construct
tgctgctcatatgcaggtagtagcactttcgtcttc

SEQ ID NO: 8821 - DNA, 33 bp, Artificial Sequence
  Synthetic construct
tgtctacagcataatagttatccgtggacgttc

SEQ ID NO: 8822 - DNA, 33 bp, Artificial Sequence
  Synthetic construct
tgtcaggcgtgggacacaagcgctgcgattttc

SEQ ID NO: 8823 - DNA, 36 bp, Artificial Sequence
  Synthetic construct
tgtaactcccgttacagcagtgcttaccaggtgttc

SEQ ID NO: 8824 - DNA, 33 bp, Artificial Sequence
  Synthetic construct
tgtcagcagtgtgataatctccctttcactttc

SEQ ID NO: 8825 - DNA, 33 bp, Artificial Sequence
  Synthetic construct
tgccaacaatataatagtttcccgtacactttt

SEQ ID NO: 8826 - DNA, 33 bp, Artificial Sequence
  Synthetic construct
tgcatgcaagatgcacaggatctgtggacgttc

SEQ ID NO: 8827 - DNA, 36 bp, Artificial Sequence
  Synthetic construct
tgtcagcaatattatagtactcttccgtcgacgttc

SEQ ID NO: 8828 - DNA, 33 bp, Artificial Sequence
  Synthetic construct
tgtcagtcttacgatagcatctcttgggtgttc

SEQ ID NO: 8829 - DNA, 33 bp, Artificial Sequence
  Synthetic construct
tgcatgcaaggtacacactggccccggacgttc

SEQ ID NO: 8830 - DNA, 39 bp, Artificial Sequence
  Synthetic construct
tgcggcacatgggatagcagcctgggaggtgtggtcttc

SEQ ID NO: 8831 - DNA, 36 bp, Artificial Sequence
  Synthetic construct
tgtcagcagcgtagcaactggcctccgctcactttc

SEQ ID NO: 8832 - DNA, 33 bp, Artificial Sequence
  Synthetic construct
tgtcagacctggggcactggcattcatgtcttc

SEQ ID NO: 8833 - DNA, 36 bp, Artificial Sequence
  Synthetic construct
tgcagctcatatacaagcagcagcactcaggtcttc

SEQ ID NO: 8834 - DNA, 33 bp, Artificial Sequence
  Synthetic construct
tgtcaacagtattatagttacccattcactttc

SEQ ID NO: 8835 - DNA, 39 bp, Artificial Sequence
  Synthetic construct
tgcacctcatatacaaacaacaccaattctcaggtattc

SEQ ID NO: 8836 - DNA, 33 bp, Artificial Sequence
  Synthetic construct
tgtcaacagagttacagtaccccccggacgttc

SEQ ID NO: 8837 - DNA, 36 bp, Artificial Sequence
  Synthetic construct
tgccaacagtataatagttattccctggggactttt

SEQ ID NO: 8838 - DNA, 36 bp, Artificial Sequence
  Synthetic construct
tgctgctcatatgcaggtaataatatcccgctattc

SEQ ID NO: 8839 - DNA, 36 bp, Artificial Sequence
  Synthetic construct
tgcatgcaaggtacacactggcctccgctcactttc

SEQ ID NO: 8840 - DNA, 36 bp, Artificial Sequence
  Synthetic construct
tgccagtcctatgacagcagcctgagtggagtcttc

SEQ ID NO: 8841 - DNA, 33 bp, Artificial Sequence
  Synthetic construct
tgtcagcaatattatagtacttcgtacactttt

SEQ ID NO: 8842 - DNA, 36 bp, Artificial Sequence
  Synthetic construct
tgcagctcatatacaatccgcagcacccatgtcttc

SEQ ID NO: 8843 - DNA, 33 bp, Artificial Sequence
  Synthetic construct
tgtcagcaatatggtagccctccgtggacgttc

SEQ ID NO: 8844 - DNA, 33 bp, Artificial Sequence
  Synthetic construct
tgccaacagtatgatagttatccggaaacgttc

SEQ ID NO: 8845 - DNA, 33 bp, Artificial Sequence
  Synthetic construct
tgtcagacctggggcactggcccttgggtgttc

SEQ ID NO: 8846 - DNA, 33 bp, Artificial Sequence
  Synthetic construct
tgtcagcagcgtagcaactggcctctcactttc

SEQ ID NO: 8847 - DNA, 33 bp, Artificial Sequence; identical to SEQ ID NO: 1837
  Synthetic construct

SEQ ID NO: 8848 - DNA, 33 bp, Artificial Sequence
  Synthetic construct
tgtcagcagtatcataactcactggacactttt

SEQ ID NO: 8849 - DNA, 33 bp, Artificial Sequence
  Synthetic construct
tgtcagcaatattatactactccgtggacgttc

SEQ ID NO: 8850 - DNA, 39 bp, Artificial Sequence
  Synthetic construct
tgtcagcagtatggtagctcacctccggcattcactttc

SEQ ID NO: 8851 - DNA, 36 bp, Artificial Sequence
  Synthetic construct
tgtgtgctctttgtgggtggtggcatttggctattc

SEQ ID NO: 8852 - DNA, 33 bp, Artificial Sequence
  Synthetic construct
tgcatgcagggtgcacactggccgtacactttt

SEQ ID NO: 8853 - DNA, 36 bp, Artificial Sequence
  Synthetic construct
tgtgtgctttatatgactagtggcattgtgctattc

SEQ ID NO: 8854 - DNA, 33 bp, Artificial Sequence
  Synthetic construct
tgttactctgcggctgacaacaatctggtattc

SEQ ID NO: 8855 - DNA, 33 bp, Artificial Sequence
  Synthetic construct
tgcatgcaagctctacaaactcctttcactttc

SEQ ID NO: 8856 - DNA, 33 bp, Artificial Sequence
  Synthetic construct
tgcatgcaagctctacaaactccttgggctttt

SEQ ID NO: 8857 - DNA, 33 bp, Artificial Sequence
  Synthetic construct
tgtcaacagtatgatgatctccctctcactttc

SEQ ID NO: 8858 - DNA, 33 bp, Artificial Sequence
  Synthetic construct
tgtcaacagtatgataatatccctctgacgttc

SEQ ID NO: 8859 - DNA, 33 bp, Artificial Sequence
  Synthetic construct
tgtcgacagacttacagtaccccgtacactttt

SEQ ID NO: 8860 - DNA, 33 bp, Artificial Sequence
  Synthetic construct
tgtcagcagcgtatcaactggccgctcaccttc

SEQ ID NO: 8861 - DNA, 33 bp, Artificial Sequence
  Synthetic construct
tgtcaacagagttacagtacccctccaagtttc

SEQ ID NO: 8862 - DNA, 33 bp, Artificial Sequence
  Synthetic construct
tgcatgcagggcacacactggccttggacgttc

SEQ ID NO: 8863 - DNA, 39 bp, Artificial Sequence
  Synthetic construct
tgtcaggtctgggattttaatagtgatcatgcactgttc

SEQ ID NO: 8864 - DNA, 36 bp, Artificial Sequence
  Synthetic construct
tgtcagtcttatgataacaattttgattgggttttc

SEQ ID NO: 8865 - DNA, 24 bp, Artificial Sequence
  Synthetic construct
tgccaataccccccgaggacgttc

SEQ ID NO: 8866 - DNA, 36 bp, Artificial Sequence
  Synthetic construct
tgtcagcactataacattgggcacggccacactttt

SEQ ID NO: 8867 - DNA, 33 bp, Artificial Sequence
  Synthetic construct
tgtcagcaatattatagtgccccgtggacgttc

SEQ ID NO: 8868 - DNA, 42 bp, Artificial Sequence
  Synthetic construct
tgtcaggtgtgggacattagtgatgagcatccttatgtcttc

SEQ ID NO: 8869 - DNA, 33 bp, Artificial Sequence
  Synthetic construct
tgtcaacagggttacagtaccccgttcaccttc

SEQ ID NO: 8870 - DNA, 33 bp, Artificial Sequence
  Synthetic construct
tgtcagtcttattatggcggcaatcaggtgttc

SEQ ID NO: 8871 - DNA, 39 bp, Artificial Sequence
  Synthetic construct
tgtggtacatggcacagcaactctaagactcgagtgttc

SEQ ID NO: 8872 - DNA, 39 bp, Artificial Sequence
  Synthetic construct
tgtgcagcttgggatgacagcctgaatggtgtagtcttc

SEQ ID NO: 8873 - DNA, 36 bp, Artificial Sequence
  Synthetic construct
tgtcaacagtattataatttcctccctctcactttc

SEQ ID NO: 8874 - DNA, 33 bp, Artificial Sequence
  Synthetic construct
tgtcagcagtatggtacctcactgttcactttt

SEQ ID NO: 8875 - DNA, 42 bp, Artificial Sequence
  Synthetic construct
tgcggaacatgggatagcagcctgagtgcaccttgggtgttc

SEQ ID NO: 8876 - DNA, 33 bp, Artificial Sequence
  Synthetic construct
tgtctgcaggctaacactatgcctctcactttc

SEQ ID NO: 8877 - DNA, 36 bp, Artificial Sequence
  Synthetic construct
tgtcaacaatattatactacttctgctctcactttc

SEQ ID NO: 8878 - DNA, 36 bp, Artificial Sequence
  Synthetic construct
tgtcagtcttttgatagcacttctcactgggtgttc

SEQ ID NO: 8879 - DNA, 39 bp, Artificial Sequence
  Synthetic construct
tgtcaagtttacgataggaatactgatcaatgggtattc

SEQ ID NO: 8880 - DNA, 39 bp, Artificial Sequence
  Synthetic construct
tgtaactcccgggacagcagtggtaaccatcaggtcttc

SEQ ID NO: 8881 - DNA, 33 bp, Artificial Sequence
  Synthetic construct
tgccaacagtatcatacttcttcggaaaccttc

SEQ ID NO: 8882 - DNA, 36 bp, Artificial Sequence
  Synthetic construct
tgccaacaatactatactttttcttcgtggacgttc

SEQ ID NO: 8883 - DNA, 30 bp, Artificial Sequence
  Synthetic construct
tgccaacagtatgataatttgtggtcgttc

SEQ ID NO: 8884 - DNA, 36 bp, Artificial Sequence
  Synthetic construct
tgcatgcaaggaacacactggcctccgtggacgttc

SEQ ID NO: 8885 - DNA, 36 bp, Artificial Sequence
  Synthetic construct
tgccaacagtataatacttattcggggtggacgttc

SEQ ID NO: 8886 - DNA, 33 bp, Artificial Sequence
  Synthetic construct
tgtctacagtacaaaaattaccctcgcacgttc

SEQ ID NO: 8887 - DNA, 36 bp, Artificial Sequence
  Synthetic construct
tgtcaatcagcggacagcagtggtacttgggtcttt

SEQ ID NO: 8888 - DNA, 39 bp, Artificial Sequence
  Synthetic construct
tgtcagtcgcatgacagcagcctgactaatttcatcttt

SEQ ID NO: 8889 - DNA, 30 bp, Artificial Sequence
  Synthetic construct
tgtcagcagcgtaccgactggtacactttt

SEQ ID NO: 8890 - DNA, 33 bp, Artificial Sequence
  Synthetic construct
tgtcaacagacttacagtatcccattcactttc

SEQ ID NO: 8891 - DNA, 39 bp, Artificial Sequence
  Synthetic construct
ttcacctcatatacaaacgacagcaattctcaggtattc

SEQ ID NO: 8892 - DNA, 36 bp, Artificial Sequence
  Synthetic construct
tgtcagcagcgtgtcaactggccgtatctcactttc

SEQ ID NO: 8893 - DNA, 36 bp, Artificial Sequence
  Synthetic construct
tgcagctcatatacaagcagcagcacttttgtcttc

SEQ ID NO: 8894 - DNA, 33 bp, Artificial Sequence
  Synthetic construct
tgccaacaatatgaaagttacccgtacactttt

SEQ ID NO: 8895 - DNA, 33 bp, Artificial Sequence
  Synthetic construct
tgcatgcaagcttcacaatttcctctcactttc

SEQ ID NO: 8896 - DNA, 36 bp, Artificial Sequence
  Synthetic construct
tgtcagcagtatgataagtggcctccgtggacgttc

SEQ ID NO: 8897 - DNA, 36 bp, Artificial Sequence
  Synthetic construct
tgcagctcatatacaagcatcagcactgtggtattc

SEQ ID NO: 8898 - DNA, 36 bp, Artificial Sequence
  Synthetic construct
tgtcaacagtataattattggcctccgtacactttt

SEQ ID NO: 8899 - DNA, 33 bp, Artificial Sequence
  Synthetic construct
tgcatgcaagctctacaaactccgtacactttt

SEQ ID NO: 8900 - DNA, 33 bp, Artificial Sequence
  Synthetic construct
tgtcagcagcgtagcagctggcctctcactttc

SEQ ID NO: 8901 - DNA, 36 bp, Artificial Sequence
  Synthetic construct
tgcaactcatatacaaacagcagcactctggtgttc

SEQ ID NO: 8902 - DNA, 39 bp, Artificial Sequence
  Synthetic construct
tgcggaacatgggatagcagcctgagtgcttatgtcttc

SEQ ID NO: 8903 - DNA, 36 bp, Artificial Sequence
  Synthetic construct
tgtcaacagagttacagtacccctcggagcaccttc

SEQ ID NO: 8904 - DNA, 30 bp, Artificial Sequence
  Synthetic construct
tgtcagcagcgtagcaactggcctcttttc

SEQ ID NO: 8905 - DNA, 39 bp, Artificial Sequence
  Synthetic construct
tgtcaggcgtgggacagcagcactgccccttatgtcttc

SEQ ID NO: 8906 - DNA, 36 bp, Artificial Sequence
  Synthetic construct
tgcagctcatatacaagcagcagcacttgggtgttc

SEQ ID NO: 8907 - DNA, 33 bp, Artificial Sequence
  Synthetic construct
tgtcaacagggtaccagtttccccttcactttc

SEQ ID NO: 8908 - DNA, 39 bp, Artificial Sequence
  Synthetic construct
tgtcagttgtgggatagtcgtagtgatcatgtggtattc

SEQ ID NO: 8909 - DNA, 24 bp, Artificial Sequence
  Synthetic construct
tgtcagcagcgtgacttcactttc

SEQ ID NO: 8910 - DNA, 33 bp, Artificial Sequence
  Synthetic construct
tgtcaacaggttaatgcttaccccttcagtttc

SEQ ID NO: 8911 - DNA, 33 bp, Artificial Sequence
  Synthetic construct
tgtcaccagtatgataactggcctctcactttc

SEQ ID NO: 8912 - DNA, 36 bp, Artificial Sequence
  Synthetic construct
tgtcagtcttgtgataacaacaatcatggagtcttc

SEQ ID NO: 8913 - DNA, 33 bp, Artificial Sequence
  Synthetic construct
tgtcagcagtattatgatgaccccctcactttc

SEQ ID NO: 8914 - DNA, 39 bp, Artificial Sequence
  Synthetic construct
tgcggaacatgggatagcagcctgagtgctgaggtcttc

SEQ ID NO: 8915 - DNA, 33 bp, Artificial Sequence
  Synthetic construct
tgtcagcagtattacacttcccctctgactttc

SEQ ID NO: 8916 - DNA, 33 bp, Artificial Sequence
  Synthetic construct
tgtcaggcgtgggacagcagcactgccgttttc

SEQ ID NO: 8917 - DNA, 36 bp, Artificial Sequence
  Synthetic construct
tgccaacagtataatagttattttccttggacgttc

SEQ ID NO: 8918 - DNA, 33 bp, Artificial Sequence
  Synthetic construct
tgtcaacagagttttagtaggcctccaactttc

SEQ ID NO: 8919 - DNA, 36 bp, Artificial Sequence
  Synthetic construct
tgctgctcatatgcaggtagtagaacttctttcttc

SEQ ID NO: 8920 - DNA, 33 bp, Artificial Sequence
  Synthetic construct
tgtcagcagcgtggcaactggccgatcaccttc

SEQ ID NO: 8921 - DNA, 39 bp, Artificial Sequence
  Synthetic construct
tgcacctcatatacaaacaacagctattctcaggtattc

SEQ ID NO: 8922 - DNA, 33 bp, Artificial Sequence
  Synthetic construct
tgtcaacagagttacagtgcccctcgtactttt

SEQ ID NO: 8923 - DNA, 42 bp, Artificial Sequence
  Synthetic construct
tgcggaacatgggataacagcctgagtgctggctatgtcttc

SEQ ID NO: 8924 - DNA, 33 bp, Artificial Sequence
  Synthetic construct
tgtcagcaatattatactactcctctgacgttc

SEQ ID NO: 8925 - DNA, 36 bp, Artificial Sequence
  Synthetic construct
tgcatctcatatacaactagcagcacttgggtgttc

SEQ ID NO: 8926 - DNA, 33 bp, Artificial Sequence
  Synthetic construct
tgtcaaacgtgggacagcaccactgcggtgttc

SEQ ID NO: 8927 - DNA, 33 bp, Artificial Sequence
  Synthetic construct
tgcatgcaaggttcacactggccattcactttc

SEQ ID NO: 8928 - DNA, 33 bp, Artificial Sequence
  Synthetic construct
tgtcagcaatattatagtactctgtacactttt

SEQ ID NO: 8929 - DNA, 33 bp, Artificial Sequence
  Synthetic construct
tgtcagcagcgtagcaactggccttggactttt

SEQ ID NO: 8930 - DNA, 30 bp, Artificial Sequence
  Synthetic construct
tgtcagcaatattatagttctatcaccttc

SEQ ID NO: 8931 - DNA, 39 bp, Artificial Sequence
  Synthetic construct
tgtcaatcagcagacagcagtggtactttcgtggtattc

SEQ ID NO: 8932 - DNA, 33 bp, Artificial Sequence
  Synthetic construct
tgtcagcaatattatagtactccattcactttc

SEQ ID NO: 8933 - DNA, 33 bp, Artificial Sequence
  Synthetic construct
tgtcagcagtataataactggcccctcactttc

SEQ ID NO: 8934 - DNA, 33 bp, Artificial Sequence
  Synthetic construct
tgtcaacagtatgataatctccctcaaactttt

SEQ ID NO: 8935 - DNA, 36 bp, Artificial Sequence
  Synthetic construct
tgtcaatcagcagacagcagtggtacttatgtcttc

SEQ ID NO: 8936 - DNA, 36 bp, Artificial Sequence
  Synthetic construct
tgtcaacagtatgataatctccctccgctcactttc

SEQ ID NO: 8937 - DNA, 33 bp, Artificial Sequence
  Synthetic construct
tgtcaacagtatgataatctccctctcactttc

SEQ ID NO: 8938 - DNA, 36 bp, Artificial Sequence
  Synthetic construct
tgtcagcagtatgataactggcctccgatcaccttc

SEQ ID NO: 8939 - DNA, 33 bp, Artificial Sequence
  Synthetic construct
tgtgtgctgtatctgggtactgtcgtgctcttc

SEQ ID NO: 8940 - DNA, 30 bp, Artificial Sequence
  Synthetic construct
tgccaacaatatgatactctgtggacgttc

SEQ ID NO: 8941 - DNA, 33 bp, Artificial Sequence
  Synthetic construct
tgtcaaaagtataacagtgccccgtacactttt

SEQ ID NO: 8942 - DNA, 33 bp, Artificial Sequence
  Synthetic construct
tgcctgctctcctatagtgatactcgggtcttc

SEQ ID NO: 8943 - DNA, 30 bp, Artificial Sequence
  Synthetic construct
tgtcagcaatttcatacttcttggacgttc

SEQ ID NO: 8944 - DNA, 39 bp, Artificial Sequence
  Synthetic construct
tgtcaatcagcagacagcagtggtacttattgggtgttc

SEQ ID NO: 8945 - DNA, 36 bp, Artificial Sequence
  Synthetic construct
tgcatgcaagatgcacaagatcctccgtacactttt

SEQ ID NO: 8946 - DNA, 33 bp, Artificial Sequence
  Synthetic construct
tgtcaacagagttacagtagtcctcggacgttc

SEQ ID NO: 8947 - DNA, 33 bp, Artificial Sequence
  Synthetic construct
tgtcaacaggccagcagtttcccattcactttc

SEQ ID NO: 8948 - DNA, 33 bp, Artificial Sequence
  Synthetic construct
tgtcaacagagttacagtaccccattcactttc

SEQ ID NO: 8949 - DNA, 33 bp, Artificial Sequence
  Synthetic construct
tgtcagcagtattctagtactccattcactttc

SEQ ID NO: 8950 - DNA, 36 bp, Artificial Sequence
  Synthetic construct
tgcaactcatatgcaggcagcgacaattgggtgttc

SEQ ID NO: 8951 - DNA, 30 bp, Artificial Sequence
  Synthetic construct
tgtcagcagtatcatttctggccttcgttc

SEQ ID NO: 8952 - DNA, 39 bp, Artificial Sequence
  Synthetic construct
tgtgcagcatgggatgacagcctgagtggttgggtgttc

SEQ ID NO: 8953 - DNA, 33 bp, Artificial Sequence
  Synthetic construct
tgcatgcaagctctacaaacccagatcaccttc

SEQ ID NO: 8954 - DNA, 36 bp, Artificial Sequence
  Synthetic construct
tgtcagcagtatggtagctcaccgcagatcaccttc

SEQ ID NO: 8955 - DNA, 36 bp, Artificial Sequence
  Synthetic construct
tgcagctcatatgcaagcgacaccagtctggtgttc

SEQ ID NO: 8956 - DNA, 33 bp, Artificial Sequence
  Synthetic construct
tgtcagcagtatggtagctcactgtggacgttc

SEQ ID NO: 8957 - DNA, 33 bp, Artificial Sequence
  Synthetic construct
tgccagcaatttaatctttatcccctcactttc

SEQ ID NO: 8958 - DNA, 39 bp, Artificial Sequence
  Synthetic construct
tgtaactcccgggacagcagtggtaaccatgtggtattc

SEQ ID NO: 8959 - DNA, 39 bp, Artificial Sequence
  Synthetic construct
tgtgcagcatgggatgacagcctgaatggtgtggtattc

SEQ ID NO: 8960 - DNA, 39 bp, Artificial Sequence
  Synthetic construct
tgcaactcatacacaagcaccaccactcttgtacttttc

SEQ ID NO: 8961 - DNA, 33 bp, Artificial Sequence
  Synthetic construct
tgtcaccagtatggtgactcaccgtggacgttc

SEQ ID NO: 8962 - DNA, 33 bp, Artificial Sequence
  Synthetic construct
tgtcaacagtataatgcttatccgatcaccttc

SEQ ID NO: 8963 - DNA, 39 bp, Artificial Sequence
  Synthetic construct
tgtcaggtgtgggatactgcttctgatcattatgtcttc

SEQ ID NO: 8964 - DNA, 33 bp, Artificial Sequence
  Synthetic construct
tgtcagcagtataataactggccccggacgttc

SEQ ID NO: 8965 - DNA, 36 bp, Artificial Sequence
  Synthetic construct
tgtcagcagtacaataattggcctccttacactttt

SEQ ID NO: 8966 - DNA, 33 bp, Artificial Sequence
  Synthetic construct
tgctgctcatatgcaggcgctacttatgtcttc

SEQ ID NO: 8967 - DNA, 33 bp, Artificial Sequence
  Synthetic construct
tgtcagcaatattatactactcccctcactttc

SEQ ID NO: 8968 - DNA, 39 bp, Artificial Sequence
  Synthetic construct
tgtcaggtgtgggacagtattagtaatcaggtgattttc

SEQ ID NO: 8969 - DNA, 36 bp, Artificial Sequence
  Synthetic construct
tgtcagcagtatcatgcgtggcccccgctcaccttc

SEQ ID NO: 8970 - DNA, 39 bp, Artificial Sequence
  Synthetic construct
tgtcagcagtacagtaagtggcctccggggttcactttc

SEQ ID NO: 8971 - DNA, 39 bp, Artificial Sequence
  Synthetic construct
tgtcaacagcgaagcaactggcctccgagtctcactttc

SEQ ID NO: 8972 - DNA, 30 bp, Artificial Sequence
  Synthetic construct
tgtcagcagtacaatagagggtggacgttc

SEQ ID NO: 8973 - DNA, 33 bp, Artificial Sequence
  Synthetic construct
tgtcaacagagttacaatatacccctcactttc

SEQ ID NO: 8974 - DNA, 39 bp, Artificial Sequence
  Synthetic construct
tgcggaacatgggatagcagcctgagtgctggactcttc

SEQ ID NO: 8975 - DNA, 30 bp, Artificial Sequence; identical to SEQ ID NO: 1836
  Synthetic construct

SEQ ID NO: 8976 - DNA, 33 bp, Artificial Sequence
  Synthetic construct
tgccaacagtataatcattaccctttcaccttc

SEQ ID NO: 8977 - DNA, 33 bp, Artificial Sequence
  Synthetic construct
tgtcaccagtattatagtactccgtccactttt

SEQ ID NO: 8978 - DNA, 33 bp, Artificial Sequence
  Synthetic construct
tgccaacagtttaatagttacacgtggacgttc

SEQ ID NO: 8979 - DNA, 36 bp, Artificial Sequence
  Synthetic construct
tgtcaggcgtgggacagcagttccctttatgtcttc

SEQ ID NO: 8980 - DNA, 39 bp, Artificial Sequence
  Synthetic construct
tgtcaacaggggaccgactggcctcacctattcactttc

SEQ ID NO: 8981 - DNA, 30 bp, Artificial Sequence
  Synthetic construct
tgtcagcagcatttcagctggatcaccttc

SEQ ID NO: 8982 - DNA, 33 bp, Artificial Sequence
  Synthetic construct
tgtatgcagggcacacactggccgctcactttc

SEQ ID NO: 8983 - DNA, 33 bp, Artificial Sequence
  Synthetic construct
tgtcaacagagtttcagaaccccgtacactttt

SEQ ID NO: 8984 - DNA, 39 bp, Artificial Sequence
  Synthetic construct
tgtgccacatgggacgacagcctgactggctatgtcttc

SEQ ID NO: 8985 - DNA, 39 bp, Artificial Sequence
  Synthetic construct
tgctcagcatgggacagcagcctcagtgcttgggtgttc

SEQ ID NO: 8986 - DNA, 33 bp, Artificial Sequence
  Synthetic construct
tgtcaacagtatagtagttatccgttcacgttt

SEQ ID NO: 8987 - DNA, 39 bp, Artificial Sequence
  Synthetic construct
tgctcttcatacataagaggcaccgcttcttttgtcttc

SEQ ID NO: 8988 - DNA, 36 bp, Artificial Sequence
  Synthetic construct
tgtcagcactatagtgactggcctccggtaactttt

SEQ ID NO: 8989 - DNA, 33 bp, Artificial Sequence
  Synthetic construct
tgcatgcaaactctccaagctccgtacactttt

SEQ ID NO: 8990 - DNA, 33 bp, Artificial Sequence
  Synthetic construct
tgtcaacaggctaacagtttcccgatcaccttc

SEQ ID NO: 8991 - DNA, 36 bp, Artificial Sequence; identical to SEQ ID NO: 1839
  Synthetic construct

SEQ ID NO: 8992 - DNA, 33 bp, Artificial Sequence
  Synthetic construct
tgtctccagcacaatagtttcccgctcactttc

SEQ ID NO: 8993 - DNA, 33 bp, Artificial Sequence
  Synthetic construct
tgtcaacagtatgaaaatctcccactcactttc

SEQ ID NO: 8994 - DNA, 30 bp, Artificial Sequence
  Synthetic construct
tgcatgcaaggtctacaaactccgactttc

SEQ ID NO: 8995 - DNA, 33 bp, Artificial Sequence
  Synthetic construct
tgtcagcaatattctagtactctttggacattc

SEQ ID NO: 8996 - DNA, 39 bp, Artificial Sequence
  Synthetic construct
tgcagctcatatgcaaccagcgacaatttaagattgttt

SEQ ID NO: 8997 - DNA, 30 bp, Artificial Sequence
  Synthetic construct
tgtcagcaatattttattactccgactttc

SEQ ID NO: 8998 - DNA, 36 bp, Artificial Sequence
  Synthetic construct
tgccaagaatataatagttaccctatgtacactttt

SEQ ID NO: 8999 - DNA, 33 bp, Artificial Sequence
  Synthetic construct
tgccaacagtacagtacttatttcgtcactttc

SEQ ID NO: 9000 - DNA, 33 bp, Artificial Sequence
  Synthetic construct
tgtcaacagagttacagtcccccgttcactttt

SEQ ID NO: 9001 - DNA, 42 bp, Artificial Sequence
  Synthetic construct
tgtcaggtgtgggatagtactggtgttcacccttttgtcttc

SEQ ID NO: 9002 - DNA, 39 bp, Artificial Sequence
  Synthetic construct
tgcggaacgtgggatgacagcctgaatgctggcgtcttc

SEQ ID NO: 9003 - DNA, 33 bp, Artificial Sequence
  Synthetic construct
tgtcagctgtattttggttcaggattcactttc

SEQ ID NO: 9004 - DNA, 33 bp, Artificial Sequence
  Synthetic construct
tgtcagcagtatggcagatcccctcggacgttc

SEQ ID NO: 9005 - DNA, 33 bp, Artificial Sequence; identical to SEQ ID NO: 1835
  Synthetic construct

SEQ ID NO: 9006 - DNA, 36 bp, Artificial Sequence
  Synthetic construct
tgcagctcatatgcaggcactaacaattttgtcttc

SEQ ID NO: 9007 - DNA, 33 bp, Artificial Sequence
  Synthetic construct
tgtcaacaatatggtaattcacctcagacgttc

SEQ ID NO: 9008 - DNA, 33 bp, Artificial Sequence
  Synthetic construct
tgtcaccagtattatgcgaccccatacaccttt

SEQ ID NO: 9009 - DNA, 33 bp, Artificial Sequence
  Synthetic construct
tgtcaacagagtttcagacccccgctcactttc

SEQ ID NO: 9010 - DNA, 36 bp, Artificial Sequence
  Synthetic construct
tgtcagcagcgtagcagctggcctccgatcaccttc

SEQ ID NO: 9011 - DNA, 39 bp, Artificial Sequence
  Synthetic construct
tgtcaggtgtgggatagtagtgttgatcccgtgatattc

SEQ ID NO: 9012 - DNA, 39 bp, Artificial Sequence
  Synthetic construct
tgcggaacatgggatgctagcgtgagtgttgcggtattc

SEQ ID NO: 9013 - DNA, 39 bp, Artificial Sequence
  Synthetic construct
tgcggagcatgggatagcagcctgaatgttgtggtgttc

SEQ ID NO: 9014 - DNA, 33 bp, Artificial Sequence
  Synthetic construct
tgtcaacaatattataatattccttggacgttc

SEQ ID NO: 9015 - DNA, 39 bp, Artificial Sequence
  Synthetic construct
tgtgcagcatgggatggcagcctgaatggttatgtcttc

SEQ ID NO: 9016 - DNA, 39 bp, Artificial Sequence
  Synthetic construct
tgtcaacaatatgagaacatccctccggggctcacgttc

SEQ ID NO: 9017 - DNA, 39 bp, Artificial Sequence
  Synthetic construct
tgcagctcatatgaaaccagcaacaatttgaggttattc

SEQ ID NO: 9018 - DNA, 33 bp, Artificial Sequence
  Synthetic construct
tgtcagcagtatggtagctcacctgggacgttc

SEQ ID NO: 9019 - DNA, 33 bp, Artificial Sequence
  Synthetic construct
tgtcagcagtatggcatctcaccgtacactttt

SEQ ID NO: 9020 - DNA, 36 bp, Artificial Sequence
  Synthetic construct
tgcatgcaagatgcacaagatcccttgttcactttc

SEQ ID NO: 9021 - DNA, 33 bp, Artificial Sequence
  Synthetic construct
tgtcagcagtctggtagctcaccgtacactttt

SEQ ID NO: 9022 - DNA, 33 bp, Artificial Sequence
  Synthetic construct
tgtcaacaatattttcgtactcctccgactttc

SEQ ID NO: 9023 - DNA, 30 bp, Artificial Sequence
  Synthetic construct
tgtcaacagagttacacttccctcactttc

SEQ ID NO: 9024 - DNA, 33 bp, Artificial Sequence
  Synthetic construct
tgtcaacaggttgatgctgacccgatcaccttc

SEQ ID NO: 9025 - DNA, 39 bp, Artificial Sequence
  Synthetic construct
tgcggaacatgggatagcagtttgagtggtggggtgttc

SEQ ID NO: 9026 - DNA, 39 bp, Artificial Sequence
  Synthetic construct
tgcgcctcatataccgttagtagtagtctcgaggtcttc

SEQ ID NO: 9027 - DNA, 33 bp, Artificial Sequence
  Synthetic construct
tgtcaacaagcaaacagtttccctcacacgttc

SEQ ID NO: 9028 - DNA, 39 bp, Artificial Sequence
  Synthetic construct
tgtgcagcatgggatgacagcctgagtggtccggtattc

SEQ ID NO: 9029 - DNA, 33 bp, Artificial Sequence
  Synthetic construct
tgcatgcaaaataaacaggtttccataaccttc

SEQ ID NO: 9030 - DNA, 39 bp, Artificial Sequence
  Synthetic construct
tgcggaacatgggataacagcctgagtgcttgggtgttc

SEQ ID NO: 9031 - DNA, 39 bp, Artificial Sequence
  Synthetic construct
tgtgcagcatgggatgacagcctgaatggttatgtcttc

SEQ ID NO: 9032 - DNA, 33 bp, Artificial Sequence
  Synthetic construct
tgtcaccagtatgataagtctccctacactttc

SEQ ID NO: 9033 - DNA, 36 bp, Artificial Sequence
  Synthetic construct
tgcctacaacatgataatttccctctcggctctttt

SEQ ID NO: 9034 - DNA, 36 bp, Artificial Sequence
  Synthetic construct
tgtcaacagagtcacagttcctctccgtggacgttc

SEQ ID NO: 9035 - DNA, 33 bp, Artificial Sequence
  Synthetic construct
tgcatgcaagctctacaaactccgtggacgttc

SEQ ID NO: 9036 - DNA, 39 bp, Artificial Sequence
  Synthetic construct
tgccagtcctatgacagcagcctgagtggttgggtgttc

SEQ ID NO: 9037 - DNA, 33 bp, Artificial Sequence
  Synthetic construct
tgtcaacaatattatgatacccctcggacgttc

SEQ ID NO: 9038 - DNA, 33 bp, Artificial Sequence
  Synthetic construct
tgtcttcagcacaatggttaccctcggtcgttc

SEQ ID NO: 9039 - DNA, 39 bp, Artificial Sequence
  Synthetic construct
tgtcagtcactagacagtagtggtgtttatgtggtattc

SEQ ID NO: 9040 - DNA, 33 bp, Artificial Sequence
  Synthetic construct
tgtcaacagtattttgatctccgtttcggtttc

SEQ ID NO: 9041 - DNA, 33 bp, Artificial Sequence
  Synthetic construct
tgcagctcgtatacaagcaacattattttattt

SEQ ID NO: 9042 - DNA, 33 bp, Artificial Sequence
  Synthetic construct
tgtcagcagactaccagtttccctctcactttc

SEQ ID NO: 9043 - DNA, 33 bp, Artificial Sequence
  Synthetic construct
tgtcagcactttaacggttctcctctcactttc

SEQ ID NO: 9044 - DNA, 42 bp, Artificial Sequence
  Synthetic construct
tgtcaggtgtgggacagtagtagtgatcacccctatgtcttc

SEQ ID NO: 9045 - DNA, 33 bp, Artificial Sequence
  Synthetic construct
tgtcaacagcttaatagttacccgctcactttc

SEQ ID NO: 9046 - DNA, 36 bp, Artificial Sequence
  Synthetic construct
tgcaactcatatacaagcagcagcacttatgtcttc

SEQ ID NO: 9047 - DNA, 33 bp, Artificial Sequence
  Synthetic construct
tgtcaacactataatgactggcaaatcactttc

SEQ ID NO: 9048 - DNA, 33 bp, Artificial Sequence
  Synthetic construct
tgcgaacagacctatagtattccgtggactttc

SEQ ID NO: 9049 - DNA, 33 bp, Artificial Sequence
  Synthetic construct
tgtcagcagcgtttcaagtggcccatcaccttc

SEQ ID NO: 9050 - DNA, 39 bp, Artificial Sequence
  Synthetic construct
tgccagtcctttgacgacagcctgaatgcttcgctgttc

SEQ ID NO: 9051 - DNA, 39 bp, Artificial Sequence
  Synthetic construct
tgtaactgccgagacaccagtggtgacccttgggtgttc

SEQ ID NO: 9052 - DNA, 36 bp, Artificial Sequence
  Synthetic construct
tgtcagcagcgtagcaactggccctcggtcactttc

SEQ ID NO: 9053 - DNA, 33 bp, Artificial Sequence
  Synthetic construct
tgcacgcaagctacacaattcccctacactttt

SEQ ID NO: 9054 - DNA, 33 bp, Artificial Sequence
  Synthetic construct
tgtcaacaggctaacagtttacctctcactttc

SEQ ID NO: 9055 - DNA, 33 bp, Artificial Sequence
  Synthetic construct
tgtcatcaaagtagtagtttaccgtacactttt

SEQ ID NO: 9056 - DNA, 33 bp, Artificial Sequence
  Synthetic construct
tgtcagcagtatggtagttcacctcggacgttc

SEQ ID NO: 9057 - DNA, 21 bp, Artificial Sequence
  Synthetic construct
tgtcaacagagtggcactttc

SEQ ID NO: 9058 - DNA, 30 bp, Artificial Sequence
  Synthetic construct
tgccaacagtatcattcttattcgacgttc

SEQ ID NO: 9059 - DNA, 39 bp, Artificial Sequence
  Synthetic construct
tgtcaggagtataatagctggcctccggagtacgctttt

SEQ ID NO: 9060 - DNA, 39 bp, Artificial Sequence
  Synthetic construct
tgtcagcagtatggtagctcacctccgatgtacaccttt

SEQ ID NO: 9061 - DNA, 33 bp, Artificial Sequence
  Synthetic construct
tgtcaacagttttttcgaaccccgtacactttt

SEQ ID NO: 9062 - DNA, 30 bp, Artificial Sequence
  Synthetic construct
tgtatgatttggtcagacgcgtatgtcttc

SEQ ID NO: 9063 - DNA, 33 bp, Artificial Sequence
  Synthetic construct
tgtcaacagtatgatgatcttccgctcactttc

SEQ ID NO: 9064 - DNA, 33 bp, Artificial Sequence
  Synthetic construct
tgtcaacaggctgacaatttgccgtggacgttc

SEQ ID NO: 9065 - DNA, 39 bp, Artificial Sequence
  Synthetic construct
tgtcagcagcgtagcgactggcctccggtgtacactttt

SEQ ID NO: 9066 - DNA, 39 bp, Artificial Sequence
  Synthetic construct
tgcgccgcttgggacgaccacctgcgaattgtgggtttc

SEQ ID NO: 9067 - DNA, 39 bp, Artificial Sequence
  Synthetic construct
tgtcaggtgtgggatagtagtagtgatccccgggtgttc

SEQ ID NO: 9068 - DNA, 33 bp, Artificial Sequence
  Synthetic construct
tgtcagcaatattatagtactccgtggacgttc

SEQ ID NO: 9069 - DNA, 39 bp, Artificial Sequence
  Synthetic construct
tgtgcagcatgggatgacagcctgaatggtcccgtcttc

SEQ ID NO: 9070 - DNA, 39 bp, Artificial Sequence
  Synthetic construct
tgccagtcctatgacaacagcctgagtggttatgtcttc

SEQ ID NO: 9071 - DNA, 39 bp, Artificial Sequence
  Synthetic construct
tgtgtcgtttgggatgtcagactgagtgggtatgtcttc

SEQ ID NO: 9072 - DNA, 33 bp, Artificial Sequence
  Synthetic construct
tgtcaacaggctaacagtttcccctacactttt

SEQ ID NO: 9073 - DNA, 33 bp, Artificial Sequence
  Synthetic construct
tgtcaacagggttacagtaccccattcactttc

SEQ ID NO: 9074 - DNA, 39 bp, Artificial Sequence
  Synthetic construct
tgtcaggtgtgggatagtattagtgagcatcaagtgttc

SEQ ID NO: 9075 - DNA, 39 bp, Artificial Sequence
  Synthetic construct
tgcggagcctgggacagcagcctgagagcggtggtgttc

SEQ ID NO: 9076 - DNA, 33 bp, Artificial Sequence
  Synthetic construct
tgtcaacagtattatagtctccctctcactttc

SEQ ID NO: 9077 - DNA, 33 bp, Artificial Sequence
  Synthetic construct
tgtcagcagtatagttcctcacctcggacgttc

SEQ ID NO: 9078 - DNA, 33 bp, Artificial Sequence
  Synthetic construct
tgcatgcaaagtctacagactccgccgacgttc

SEQ ID NO: 9079 - DNA, 33 bp, Artificial Sequence
  Synthetic construct
tgtcaacagagtttcagctccctttggacgttc

SEQ ID NO: 9080 - DNA, 36 bp, Artificial Sequence
  Synthetic construct
tgcagctcctatacaagcggtcgtattctggttttc

SEQ ID NO: 9081 - DNA, 33 bp, Artificial Sequence
  Synthetic construct
tgcatgcaaactctacaaactcctctcactttc

SEQ ID NO: 9082 - DNA, 33 bp, Artificial Sequence
  Synthetic construct
tgtcaacagtattatagttaccccctcactttc

SEQ ID NO: 9083 - DNA, 39 bp, Artificial Sequence
  Synthetic construct
tgtaactcccgggacagcagtggtaaccattgggtgttc

SEQ ID NO: 9084 - DNA, 39 bp, Artificial Sequence
  Synthetic construct
tgcggaacatgggatagcagcctgagtgctgtggtattc

SEQ ID NO: 9085 - DNA, 39 bp, Artificial Sequence
  Synthetic construct
tgcggaacatgggatagcagcctgagtgctaaagtattc

SEQ ID NO: 9086 - DNA, 36 bp, Artificial Sequence
  Synthetic construct
tgtcaacagagttacagtacccccccgtacactttt

SEQ ID NO: 9087 - DNA, 33 bp, Artificial Sequence
  Synthetic construct
tgtcaacagagttacagtacccctagaacgttc

SEQ ID NO: 9088 - DNA, 30 bp, Artificial Sequence
  Synthetic construct
tgtcaacagtatgattatatccctcgcttc

SEQ ID NO: 9089 - DNA, 30 bp, Artificial Sequence
  Synthetic construct
tgtcaacaatattattcttactctacgttc

SEQ ID NO: 9090 - DNA, 33 bp, Artificial Sequence
  Synthetic construct
tgtcagcaatattttagtactccgtacactttt

SEQ ID NO: 9091 - DNA, 36 bp, Artificial Sequence
  Synthetic construct
tgtcagcagcgtagcacctggcctccggggactttc

SEQ ID NO: 9092 - DNA, 33 bp, Artificial Sequence
  Synthetic construct
tgccaacaatatgagagttatccgatcactttc

SEQ ID NO: 9093 - DNA, 33 bp, Artificial Sequence
  Synthetic construct
tgtcaacattattataattaccctttcactttc

SEQ ID NO: 9094 - DNA, 33 bp, Artificial Sequence
  Synthetic construct
tgtctacagcataatagttaccctcggacgttc

SEQ ID NO: 9095 - DNA, 33 bp, Artificial Sequence
  Synthetic construct
tgtcaacaatattataatactccgtacactttt

SEQ ID NO: 9096 - DNA, 33 bp, Artificial Sequence
  Synthetic construct
tgtcagcagtataataactggcctcacactttt

SEQ ID NO: 9097 - DNA, 33 bp, Artificial Sequence
  Synthetic construct
tgtcagacctggggcaaaggcattcaggtgttt

SEQ ID NO: 9098 - DNA, 39 bp, Artificial Sequence
  Synthetic construct
tgtcagtcctatgacaacagcctgagaacttcggtgttc

SEQ ID NO: 9099 - DNA, 33 bp, Artificial Sequence
  Synthetic construct
tgtcaccaatataaaaacgcggggtggacgttc

SEQ ID NO: 9100 - DNA, 33 bp, Artificial Sequence
  Synthetic construct
tgtcagcagcgtgacacctggccttggacgttc

SEQ ID NO: 9101 - DNA, 33 bp, Artificial Sequence
  Synthetic construct
tgtcaacagtttaatagttaccctcgcactttc

SEQ ID NO: 9102 - DNA, 33 bp, Artificial Sequence
  Synthetic construct
tgcctgctctactatggtggtgcttgggtgttc

SEQ ID NO: 9103 - DNA, 33 bp, Artificial Sequence
  Synthetic construct
tgtcagcagtatggtagctcacttatcaccttc

SEQ ID NO: 9104 - DNA, 33 bp, Artificial Sequence
  Synthetic construct
tgtcagcagtatggtagctcacctctcactttc

SEQ ID NO: 9105 - DNA, 33 bp, Artificial Sequence
  Synthetic construct
tgccaacagtataatagttatccgtacactttt

SEQ ID NO: 9106 - DNA, 33 bp, Artificial Sequence
  Synthetic construct
tgtcaacagtattatagtttcccgctcactttc

SEQ ID NO: 9107 - DNA, 33 bp, Artificial Sequence
  Synthetic construct
tgccaacagtataatagttatttgtggacgttc

SEQ ID NO: 9108 - DNA, 36 bp, Artificial Sequence
  Synthetic construct
tgtcagcagtatggtagctcaccactattcactttc

SEQ ID NO: 9109 - DNA, 39 bp, Artificial Sequence
  Synthetic construct
tgtaactcccgggacagcagtggtaaccatgtggtcttc

SEQ ID NO: 9110 - DNA, 33 bp, Artificial Sequence
  Synthetic construct
tgtcaacagtttgataatctccctatcaccttc

SEQ ID NO: 9111 - DNA, 33 bp, Artificial Sequence
  Synthetic construct
tgtcaacagagttacagcatcccgtacactttt

SEQ ID NO: 9112 - DNA, 33 bp, Artificial Sequence
  Synthetic construct
tgcatgcaacgtatagagtttccttggacgttc

SEQ ID NO: 9113 - DNA, 33 bp, Artificial Sequence
  Synthetic construct
tgccaacactataatggttatccgtggacgttc

SEQ ID NO: 9114 - DNA, 33 bp, Artificial Sequence
  Synthetic construct
tgtcaacagcttaatagttaccctcctcatttc

SEQ ID NO: 9115 - DNA, 36 bp, Artificial Sequence
  Synthetic construct
tgcagctcatatacaagcagcagcacttatgtcttc

SEQ ID NO: 9116 - DNA, 33 bp, Artificial Sequence
  Synthetic construct
tgtcaacaggctaacagtttcccgtacactttt

SEQ ID NO: 9117 - DNA, 33 bp, Artificial Sequence
  Synthetic construct
tgtcagcagtataataactggccgtacactttt

SEQ ID NO: 9118 - DNA, 33 bp, Artificial Sequence
  Synthetic construct
tgtcaacagagttacagtaccctctacactttt

SEQ ID NO: 9119 - DNA, 36 bp, Artificial Sequence
  Synthetic construct
tgtcagcaatattatactactcccacgtggacgttc

SEQ ID NO: 9120 - DNA, 39 bp, Artificial Sequence
  Synthetic construct
tgccaggtgtgggataacactgatgatcctgtggtattc

SEQ ID NO: 9121 - DNA, 33 bp, Artificial Sequence
  Synthetic construct
tgtcagcagagtctcagtaccctgatcactttt

SEQ ID NO: 9122 - DNA, 33 bp, Artificial Sequence
  Synthetic construct
tgtcaacagagttacattacccctctcactttc

SEQ ID NO: 9123 - DNA, 36 bp, Artificial Sequence
  Synthetic construct
tgctcctcatacgcaagtgggggcactgtggttttc

SEQ ID NO: 9124 - DNA, 33 bp, Artificial Sequence
  Synthetic construct
tgtcagcagggtaacaactggccgctcactttc

SEQ ID NO: 9125 - DNA, 36 bp, Artificial Sequence
  Synthetic construct
tgtcagacttgggacagcagcacttcttatctcttc

SEQ ID NO: 9126 - DNA, 36 bp, Artificial Sequence
  Synthetic construct
tgtcagcaatattatagtgctcctccctggacgttc

SEQ ID NO: 9127 - DNA, 39 bp, Artificial Sequence
  Synthetic construct
tgtgcaacatgggatgacagtctgaatgctgtggttttc

SEQ ID NO: 9128 - DNA, 45 bp, Artificial Sequence
  Synthetic construct
tgcgaagcatgggagagcagcctgagtggtggccatggggtcttc

SEQ ID NO: 9129 - DNA, 33 bp, Artificial Sequence
  Synthetic construct
tgtcaacaacttaatacttaccctcggactttc

SEQ ID NO: 9130 - DNA, 33 bp, Artificial Sequence
  Synthetic construct
tgtcaacagagttacaagttccctcggacgttc

SEQ ID NO: 9131 - DNA, 39 bp, Artificial Sequence
  Synthetic construct
tgccagtcctatgacagcagcctgagtggtgtggttttc

SEQ ID NO: 9132 - DNA, 39 bp, Artificial Sequence
  Synthetic construct
tgtcaatcagcagacagcagtgattcttatagggtcttc

SEQ ID NO: 9133 - DNA, 33 bp, Artificial Sequence
  Synthetic construct
tgtcagtactatggtggctcaccaaagacgttc

SEQ ID NO: 9134 - DNA, 30 bp, Artificial Sequence
  Synthetic construct
tgccaacattattatagtcaaacaatgttc

SEQ ID NO: 9135 - DNA, 33 bp, Artificial Sequence
  Synthetic construct
tgtcaacagagtgacagtaccctgccctctttc

SEQ ID NO: 9136 - DNA, 33 bp, Artificial Sequence
  Synthetic construct
tgtcagcagtatggtagctcactctggacgttc

SEQ ID NO: 9137 - DNA, 39 bp, Artificial Sequence
  Synthetic construct
tgccagtcccatgacaccagccttcctggttcggtgttc

SEQ ID NO: 9138 - DNA, 33 bp, Artificial Sequence
  Synthetic construct
tgtcaacagagtttcagttccgtttggacgttc

SEQ ID NO: 9139 - DNA, 33 bp, Artificial Sequence
  Synthetic construct
tgcctgcagtatgatcactggatttacactttt

SEQ ID NO: 9140 - DNA, 33 bp, Artificial Sequence
  Synthetic construct
tgcatgcaaggtacacattggcctccgggcttc

SEQ ID NO: 9141 - DNA, 30 bp, Artificial Sequence
  Synthetic construct
tgtcagcagcgtagcgactggctcactttc

SEQ ID NO: 9142 - DNA, 39 bp, Artificial Sequence
  Synthetic construct
tgctgctcatattcaagaggggacaccctgtatgtcttc

SEQ ID NO: 9143 - DNA, 33 bp, Artificial Sequence
  Synthetic construct
tgtcagcaatattataataagcctcccactttt

SEQ ID NO: 9144 - DNA, 33 bp, Artificial Sequence
  Synthetic construct
tgtcaggcgtgggacagcagcactgtgctattc

SEQ ID NO: 9145 - DNA, 33 bp, Artificial Sequence
  Synthetic construct
tgtcagcaatatactctctcgcctcacaatttt

SEQ ID NO: 9146 - DNA, 39 bp, Artificial Sequence
  Synthetic construct
tgccagtcctatgacagcagcctgagtggtcatgttttc

SEQ ID NO: 9147 - DNA, 33 bp, Artificial Sequence
  Synthetic construct
tgtcaacagagttacattaccccgtggacgttc

SEQ ID NO: 9148 - DNA, 36 bp, Artificial Sequence
  Synthetic construct
tgctgctcatatgcaggcagctacactttggtgttc

SEQ ID NO: 9149 - DNA, 33 bp, Artificial Sequence
  Synthetic construct
tgtcaacagagttacagtacccctcggactttt

SEQ ID NO: 9150 - DNA, 42 bp, Artificial Sequence
  Synthetic construct
tgtcaggtgtgggataatagtagtgatcatcctttagtattc

SEQ ID NO: 9151 - DNA, 36 bp, Artificial Sequence
  Synthetic construct
tgtcttcaggattccaattacccttttgtcactttt

SEQ ID NO: 9152 - DNA, 33 bp, Artificial Sequence
  Synthetic construct
tgtcaacagtattatagttacccgtacactttt

SEQ ID NO: 9153 - DNA, 33 bp, Artificial Sequence
  Synthetic construct
tgtcaacagagtttcactacccctcccactttt

SEQ ID NO: 9154 - DNA, 33 bp, Artificial Sequence
  Synthetic construct
tgtcagcaatatgatacgtggcctcggactttt

SEQ ID NO: 9155 - DNA, 39 bp, Artificial Sequence
  Synthetic construct
tgctgctcatatgcaggcaggaactcggggaatgtcttc

SEQ ID NO: 9156 - DNA, 39 bp, Artificial Sequence
  Synthetic construct
tgtcaggtgtgggacagtagtagtgatcatccggtattc

SEQ ID NO: 9157 - DNA, 33 bp, Artificial Sequence
  Synthetic construct
tgtcaacagtattatagttccccgtacactttt

SEQ ID NO: 9158 - DNA, 39 bp, Artificial Sequence
  Synthetic construct
tgtcaggtgtgggaccattctaatgatcattttgtcttc

SEQ ID NO: 9159 - DNA, 39 bp, Artificial Sequence
  Synthetic construct
tgccagtcctttgacagcagcctgagtggttttgtcttc

SEQ ID NO: 9160 - DNA, 39 bp, Artificial Sequence
  Synthetic construct
tgcggaacatgggatagcagcctgactgctggggtcttc

SEQ ID NO: 9161 - DNA, 33 bp, Artificial Sequence
  Synthetic construct
tgtcagcagtatggttcctctttattcactttc

SEQ ID NO: 9162 - DNA, 33 bp, Artificial Sequence
  Synthetic construct
tgtcaacagagttacagtacccctccgacgttc

SEQ ID NO: 9163 - DNA, 33 bp, Artificial Sequence
  Synthetic construct
tgcatgcaaggtatacaccttccgtggacgttc

SEQ ID NO: 9164 - DNA, 39 bp, Artificial Sequence
  Synthetic construct
tgtcagcagtataataactggcctcccaaatacactttt

SEQ ID NO: 9165 - DNA, 39 bp, Artificial Sequence
  Synthetic construct
tgctgctcatatgcaggtagtagcactttcgtgctattc

SEQ ID NO: 9166 - DNA, 36 bp, Artificial Sequence
  Synthetic construct
tgctgttcatattcaggcaggaacaacgatgtcttc

SEQ ID NO: 9167 - DNA, 39 bp, Artificial Sequence
  Synthetic construct
tgtgcagcatgggatgacagcctgaatactaatgtcttc

SEQ ID NO: 9168 - DNA, 33 bp, Artificial Sequence
  Synthetic construct
tgtcagtggagttccagtgtcttggtgacgttc

SEQ ID NO: 9169 - DNA, 36 bp, Artificial Sequence
  Synthetic construct
tgtcagtcagcagacagcagtggcacttgggtgttc

SEQ ID NO: 9170 - DNA, 30 bp, Artificial Sequence
  Synthetic construct
tgtcaacagcgtagcaactggtggacgttc

SEQ ID NO: 9171 - DNA, 36 bp, Artificial Sequence
  Synthetic construct
tgcacctcatatacaggcatctctctctatgtcttc

SEQ ID NO: 9172 - DNA, 30 bp, Artificial Sequence
  Synthetic construct
tgccagcaatatagtggttattggacgttc

SEQ ID NO: 9173 - DNA, 30 bp, Artificial Sequence
  Synthetic construct
tgtcagcaatatgatacctcagggacgttc

SEQ ID NO: 9174 - DNA, 33 bp, Artificial Sequence
  Synthetic construct
tgtcaatcagcaaacagcagtgcctccgtcttc

SEQ ID NO: 9175 - DNA, 33 bp, Artificial Sequence
  Synthetic construct
tgtcagctctatgataactcccggtacactttt

SEQ ID NO: 9176 - DNA, 36 bp, Artificial Sequence
  Synthetic construct
tgtcaacagcttagttcttaccctccgatcaccttc

SEQ ID NO: 9177 - DNA, 39 bp, Artificial Sequence
  Synthetic construct
tgcggaacatgggataccagcctgagtggtgtggttttc

SEQ ID NO: 9178 - DNA, 33 bp, Artificial Sequence
  Synthetic construct
tgtctacagtataataattaccctcgcacgttc

SEQ ID NO: 9179 - DNA, 39 bp, Artificial Sequence
  Synthetic construct
tgctgttcatatgcaggtagtagccctaattatgtcttc

SEQ ID NO: 9180 - DNA, 39 bp, Artificial Sequence; identical to SEQ ID NO: 1840
  Synthetic construct

SEQ ID NO: 9181 - DNA, 39 bp, Artificial Sequence
  Synthetic construct
tgtcacctgtgggatagtagtagtggtcgctgggtgttt

SEQ ID NO: 9182 - DNA, 36 bp, Artificial Sequence
  Synthetic construct
tgtcagcactatggagactcagcggcgtacactttt

SEQ ID NO: 9183 - DNA, 33 bp, Artificial Sequence
  Synthetic construct
tgtcaacaggctgacactttcccattcaatttc

SEQ ID NO: 9184 - DNA, 33 bp, Artificial Sequence
  Synthetic construct
tgtcagcagtatgctagttcacctcggacgttc

SEQ ID NO: 9185 - DNA, 30 bp, Artificial Sequence
  Synthetic construct
tgtcaacaatatggtagtacactcactttc

SEQ ID NO: 9186 - DNA, 42 bp, Artificial Sequence
  Synthetic construct
tgtcaggtgtgggatagtagttctgctcatgtttatgtcttc

SEQ ID NO: 9187 - DNA, 39 bp, Artificial Sequence
  Synthetic construct
tgctgctcatatgcaggtagcagtcttcattatgtcttc

SEQ ID NO: 9188 - DNA, 36 bp, Artificial Sequence
  Synthetic construct
tgccagtcctatgacaccagcctgagtggtgtcttc

SEQ ID NO: 9189 - DNA, 30 bp, Artificial Sequence
  Synthetic construct
tgccaacaatataatagttattgcagtttt

SEQ ID NO: 9190 - DNA, 78 bp, Artificial Sequence
  Synthetic construct
gaaattgtgttgacgcagtctccagacaccctgtctttgtttccaggggaaagagccaccctctcctgcagggccagt

SEQ ID NO: 9191 - DNA, 78 bp, Artificial Sequence
  Synthetic construct
gacatccagatgacccagtctccttccaccctgtctgcttctgttggagacagagtcatcattacttgccgggccagt

SEQ ID NO: 9192 - DNA, 75 bp, Artificial Sequence
  Synthetic construct
cagtctgccctgactcagcctgcctccgtgtctgggtctcctggacagtcgatcaccatctcctgcactggaacc

SEQ ID NO: 9193 - DNA, 78 bp, Artificial Sequence
  Synthetic construct
gacatccagatgacccagtctccatcctccctgtctgcatctgtcggagacagagtcaccatcacttgccgggcgagt

SEQ ID NO: 9194 - DNA, 78 bp, Artificial Sequence
  Synthetic construct
gaaaatgtgttgacgcagtttccaggcaccctgtctttgtctccaggggaaagagccaccctctcctgcagggccagt

SEQ ID NO: 9195 - DNA, 78 bp, Artificial Sequence
  Synthetic construct
gaaattgtgttgacgcagtctccaggcaccctgtctttgtctccaggggaaagagccaccctctcctgcagggccagg

SEQ ID NO: 9196 - DNA, 75 bp, Artificial Sequence
  Synthetic construct
caggctgtggtgactcaggagccctcactgactgtgtccccaggggggacagtcactctcacctgtggctccagc

SEQ ID NO: 9197 - DNA, 75 bp, Artificial Sequence
  Synthetic construct
caatctgccctgactcagcctcgctcagtgtccgggtctcttggacagtcagtcaccatctcctgcactggaacc

SEQ ID NO: 9198 - DNA, 78 bp, Artificial Sequence
  Synthetic construct
gaaattgtgttgacgcagtctccaggcaccctgtctgtgtctccaggggaaagagtcaccctctcctgcagggccagt

SEQ ID NO: 9199 - DNA, 78 bp, Artificial Sequence
  Synthetic construct
gacatccagatgacccagtctccttccaccctgtctccatctgtaggagacagagtcaccatcacttgccgggccagt

SEQ ID NO: 9200 - DNA, 78 bp, Artificial Sequence
  Synthetic construct
gacatcgttatgacccagtctccagacttcctggctgtgtctctgggcgagagggccaccatcaactgcaagtccagc

SEQ ID NO: 9201 - DNA, 75 bp, Artificial Sequence
  Synthetic construct
tccgatgaattgacacagccaccctcgatgtcagtgtcactaggacaaacggccaggatcacctgctctggagat

SEQ ID NO: 9202 - DNA, 78 bp, Artificial Sequence
  Synthetic construct
gaacttgtcttgacacagtctccagccaccctgtctttgtctccaggggaaagagccaccctctcctgcagggccagt

SEQ ID NO: 9203 - DNA, 78 bp, Artificial Sequence
  Synthetic construct
gacatcgtgatgacccagtccccagactccctgactgtgtctctgggcgagagggccaccatcaactgcaagtccagc

SEQ ID NO: 9204 - DNA, 78 bp, Artificial Sequence
  Synthetic construct
gaaattgtgctgacgcagtctccaggcaccctgtctttgtctccaggggaaagagccaccctctcctgcagggccagt

SEQ ID NO: 9205 - DNA, 75 bp, Artificial Sequence
  Synthetic construct
gctgatccttggtctcctgctcctcaggctcaccagggcccagcactgactcactggcatgtatttctccctctt

SEQ ID NO: 9206 - DNA, 78 bp, Artificial Sequence
  Synthetic construct
gacatcgtgatgacccagtctccagactccctggctgtgtctctgggcgagcgggccaccatctcctgcaagtccagc

SEQ ID NO: 9207 - DNA, 75 bp, Artificial Sequence
  Synthetic construct
cagtctgtgctgacgcagccgccctcagtgtctggggccccaggccagagggtcaccatctcctgcactgggagc

SEQ ID NO: 9208 - DNA, 75 bp, Artificial Sequence
  Synthetic construct
cagtctgccctgactcagcctccctccgcgtccgggtctcttggacagtcagtcaccatctcctgcactggaacc

SEQ ID NO: 9209 - DNA, 78 bp, Artificial Sequence
  Synthetic construct
gacatcgtgatgacccagtctccagactccctggctgtgtctctgggcgagagggccaccatcaactgcaagtccagc

SEQ ID NO: 9210 - DNA, 75 bp, Artificial Sequence
  Synthetic construct
tcttctgagctgactcaggaccctgctgtgtctgtggccttgggacagacagtcaagatcacatgccaaggagac

SEQ ID NO: 9211 - DNA, 75 bp, Artificial Sequence
  Synthetic construct
aattttatactgactcagccccactctgtgtcggagtctccggggaagacggtcatcatctcctgcacccgcagc

SEQ ID NO: 9212 - DNA, 78 bp, Artificial Sequence
  Synthetic construct
gacatcgtgatgacccaatctccaggctccctggctgtctctctgggcgagagggccacaataacctgcaagtccagc

SEQ ID NO: 9213 - DNA, 78 bp, Artificial Sequence
  Synthetic construct
gaaattgtgctgactcagtctccgggctttcagtatgtgactccaaaggagaaagtcaccgtcacctgccgggccagt

SEQ ID NO: 9214 - DNA, 78 bp, Artificial Sequence
  Synthetic construct
gaaattgtgttgacgcagtctccaggcaccctgtctttgtctccaggggaaagagccaccctctcctgcagggccagt

SEQ ID NO: 9215 - DNA, 78 bp, Artificial Sequence
  Synthetic construct
gaaattgtgttgacgcagtctcctggcaccctgtctttgtctccaggggaaagagccaccctctcctgcagggccagt

SEQ ID NO: 9216 - DNA, 78 bp, Artificial Sequence
  Synthetic construct
gaaattgtgttgacgcagtctccaggcaccctgtctttgtctccaggggaaagagccaccctctcttgcagggccagt

SEQ ID NO: 9217 - DNA, 75 bp, Artificial Sequence
  Synthetic construct
tcctatgtgttgactcagccaccctcggtgtcagtggccccaggacagacggccaccattacctgtgggggatac

SEQ ID NO: 9218 - DNA, 75 bp, Artificial Sequence
  Synthetic construct
cagtctgtgctgactcagccaccctcagcgtctgggacccccgggcagagggtctccatctcttgttctggagcc

SEQ ID NO: 9219 - DNA, 78 bp, Artificial Sequence
  Synthetic construct
gacatccagatgacccagtctccatcctccctgtctgcatctattggagacagagtcaccctcacttgtcgggcaagt

SEQ ID NO: 9220 - DNA, 75 bp, Artificial Sequence
  Synthetic construct
ctgtctgccctgactcagcctgcctccgtgtctgggtctcctggacagccgatcaccatctcctgcactggaagc

SEQ ID NO: 9221 - DNA, 78 bp, Artificial Sequence
  Synthetic construct
gaaattgtgatgacccagactccactctctctgtccgtcacccctggacagccggcctccatctcctgcaagtctagt

SEQ ID NO: 9222 - DNA, 78 bp, Artificial Sequence
  Synthetic construct
gccatccagttgacccagtctccatcctccctgtctgcgtctgtaggagacagagccaccatcacttgccgggccagt

SEQ ID NO: 9223 - DNA, 78 bp, Artificial Sequence
  Synthetic construct
gccatccggatgacccagtctccatcctcactctctgcatctacaggagacagagtcaccatcacttgtcgggcgagt

SEQ ID NO: 9224 - DNA, 75 bp, Artificial Sequence
  Synthetic construct
tccgacgagttgacacagccaccctcggtgtcagtgtccccaggacagacggccaggatcgcctgctctggagat

SEQ ID NO: 9225 - DNA, 75 bp, Artificial Sequence
  Synthetic construct
cagtctgtgctgactcagccaccctcagcgtctgggacccccgggcagagggtcaccatctcttgttctggaagc

SEQ ID NO: 9226 - DNA, 78 bp, Artificial Sequence
  Synthetic construct
gacatccagatgacccagtctccttccaccctgtctgcatctgtaggagacagagtcaccatctcttgccgggccagt

SEQ ID NO: 9227 - DNA, 75 bp, Artificial Sequence
  Synthetic construct
cagtctgccctgactcagcctgcctccgtatctgggtctgctggacagtcgatcaccatctcctgcactggatcc

SEQ ID NO: 9228 - DNA, 78 bp, Artificial Sequence
  Synthetic construct
gacatccagatgacccagtctccatcttccgtgtctgcatctgtaggagacagagtcacgatttcttgtcgggcgagt

SEQ ID NO: 9229 - DNA, 75 bp, Artificial Sequence
  Synthetic construct
cagcctgtgctgactcagccaccttctgcatcagcctccctgggagcctcggtcacactcacctgcaccctgagc

SEQ ID NO: 9230 - DNA, 78 bp, Artificial Sequence
  Synthetic construct
gccatccaaatgacccagtctccatccttcctgtctgcatctgtaggagacagagtcaccctcacttgccgggccagt

SEQ ID NO: 9231 - DNA, 78 bp, Artificial Sequence
  Synthetic construct
gatgttgtgctgactcagtctccactctccctgcccgtcacccttggacagccggcctccatctcctgcatgtctagt

SEQ ID NO: 9232 - DNA, 78 bp, Artificial Sequence; identical to SEQ ID NO: 1844
  Synthetic construct

SEQ ID NO: 9233 - DNA, 75 bp, Artificial Sequence
  Synthetic construct
caatctgccctgactcagcctgcctctgtgtctgggtctcctggacagtcgatcaccatctcctgcactggaacc

SEQ ID NO: 9234 - DNA, 75 bp, Artificial Sequence
  Synthetic construct
cagtctgccctgactcagcctgcctccgtgtctgggtctcctggacagtcgatcaccatctcctgcactgggagt

SEQ ID NO: 9235 - DNA, 75 bp, Artificial Sequence
  Synthetic construct
cagtctgccctgactcagcctgcctccgtgtctgggtctcctggacagtcgatcaccatctcctgcactggatcc

SEQ ID NO: 9236 - DNA, 75 bp, Artificial Sequence
  Synthetic construct
tcctatgtgctgactcagccaccctcggtgtcagtggccccaggacagacggccaggattacctgtgggggaaac

SEQ ID NO: 9237 - DNA, 78 bp, Artificial Sequence
  Synthetic construct
gagattgtgttgacacagtctccagccaccctgtctttgtctccaggggaaagagccaccctctcctgcagggccagt

SEQ ID NO: 9238 - DNA, 78 bp, Artificial Sequence
  Synthetic construct
gatgttgtgatgactcagtctccactctccctgcccgtcacccttggacagccggcctccatctcctgcaggtctagt

SEQ ID NO: 9239 - DNA, 78 bp, Artificial Sequence
  Synthetic construct
gaaatagtgatgacgcagtctccagccaccctgtctgtgtctccaggggaaagcgccaccctctcctgcagggccagt

SEQ ID NO: 9240 - DNA, 75 bp, Artificial Sequence
  Synthetic construct
cagttaatgctgactcaagcgccctctgcctctgcctcactgggagcctcacttaacctcaaatgcactctggac

SEQ ID NO: 9241 - DNA, 75 bp, Artificial Sequence
  Synthetic construct
cagtctgtgctgacgcagccgccctcagtgtctggggccccagggcagagggtcaccatctcctgcactgggagc

SEQ ID NO: 9242 - DNA, 78 bp, Artificial Sequence
  Synthetic construct
gaaattgtgttgacacagtctccagccaccctgtctttgtctccaggggaaagagtcaccctctcctgcagggccagt

SEQ ID NO: 9243 - DNA, 78 bp, Artificial Sequence
  Synthetic construct
gaaattgtgttgacgcagtctccaggcaccctgtctttgtctcttggggaaagagccaccctctcctgcagggcccgt

SEQ ID NO: 9244 - DNA, 78 bp, Artificial Sequence
  Synthetic construct
gatgttgtgttgactcagtctccaccctccctgcccgtcgcccttggacagccggcctccatctcctgcaggtctagt

SEQ ID NO: 9245 - DNA, 78 bp, Artificial Sequence
  Synthetic construct
gacttcgtgctgacccagtctccagagtccctggctgtgtctctgggcgagagggccaccatcaactgcaagtccagc

SEQ ID NO: 9246 - DNA, 78 bp, Artificial Sequence
  Synthetic construct
gaaattgtgttgacccagtctccagccaccctgtctttgtctccaggggaaagagccgccctctcctgcagggccagt

SEQ ID NO: 9247 - DNA, 75 bp, Artificial Sequence
  Synthetic construct
caggctgtggtgactcaggagccctcactgactgtgtccccaggagggacagtcactctcacctgtggctccagc

SEQ ID NO: 9248 - DNA, 78 bp, Artificial Sequence
  Synthetic construct
gacatccagatgacccagtctccatcctccctgtctgcatctgtaggagacagagtcaccatcacttgccgggcaagt

SEQ ID NO: 9249 - DNA, 78 bp, Artificial Sequence
  Synthetic construct
gaaatagtggtgacgcagtctccagccaccctgtctctatctccaggggaaggaggcaccctctcctgcagggccagt

SEQ ID NO: 9250 - DNA, 78 bp, Artificial Sequence
  Synthetic construct
gatgttgtgatgactcagtctccactctccctgcccgtcacccttggacagccggcctccatctcctgcaggtccagt

SEQ ID NO: 9251 - DNA, 78 bp, Artificial Sequence
  Synthetic construct
gacatccagttgacccagtctccatcctccctgtctgcatctataggagacagagtcaccttcacttgcctggccagt

SEQ ID NO: 9252 - DNA, 78 bp, Artificial Sequence
  Synthetic construct
gacatccagatgacccagtctccatcctccctgtctacatctgtcggagacagagtgaccatcacgtgccaggcgagt

SEQ ID NO: 9253 - DNA, 78 bp, Artificial Sequence
  Synthetic construct
gacatccagatgacccagtctccatcctccctgtctgcatctgtaggagacagagtcaccatcacttgccgggcgagt

SEQ ID NO: 9254 - DNA, 78 bp, Artificial Sequence
  Synthetic construct
gaaattgtgttgacacagtctccagccaccctgtctttgtctccaggagaaagagccaccctctcctgcagggccagt

SEQ ID NO: 9255 - DNA, 78 bp, Artificial Sequence
  Synthetic construct
gacatccagatgacccagtctccatcctccctgtctgcatctgtaggagacagagttaccatcacttgccgggctagt

SEQ ID NO: 9256 - DNA, 78 bp, Artificial Sequence
  Synthetic construct
gacatccagatgacccagtctccctcctccctgtctgcatctgtcggagacagagtcaccatcacttgccgggcaagt

SEQ ID NO: 9257 - DNA, 78 bp, Artificial Sequence
  Synthetic construct
gacatccagatgacccagtctccatcctccctgtctgcatctgtgggagacagagtcaccatcacttgccgggcaagt

SEQ ID NO: 9258 - DNA, 78 bp, Artificial Sequence
  Synthetic construct
gacatccacctgacccagtctccatcctccctgtctgcatctgcaggagacagggtcctcatcacttgccaggcgagt

SEQ ID NO: 9259 - DNA, 78 bp, Artificial Sequence
  Synthetic construct
gaagttgtgttgacgcagtctccagacaccctctctttatatccaggggaaagagccaccctctcctgcagggccagt

SEQ ID NO: 9260 - DNA, 78 bp, Artificial Sequence
  Synthetic construct
gaaattgtgttgacgcagtctccagacaccctgtctttgtctccaggggaaagagccaccctctcctgtagggccagt

SEQ ID NO: 9261 - DNA, 78 bp, Artificial Sequence
  Synthetic construct
gacattcagatgactcagtcccccagctccctgtcagcaagcgtgggggaccgggtctccatcacctgccaggcctca

SEQ ID NO: 9262 - DNA, 78 bp, Artificial Sequence
  Synthetic construct
gacatccagatgacccagtctccttccaccctgtctgcatctgtaggagacagagtcaccatcacttgccgggccagt

SEQ ID NO: 9263 - DNA, 78 bp, Artificial Sequence
  Synthetic construct
gaaatagtgatgaggcagtctccagccaccctgtctgtgtctccaggggaaagagccaccctctcctgcagggccagt

SEQ ID NO: 9264 - DNA, 78 bp, Artificial Sequence
  Synthetic construct
gaaatagtgatgacgcagtctccagccaccctgtctgtgtctccaggggggcgagccaccctctcctgcagggccagt

SEQ ID NO: 9265 - DNA, 78 bp, Artificial Sequence
  Synthetic construct
gaaatagtgatgacgcagtctccagccaccctgtctgtgtctccaggggaaagagccaccctctcctgcagggccagt

SEQ ID NO: 9266 - DNA, 78 bp, Artificial Sequence
  Synthetic construct
gaaatagtgatgacgcagtccccagccaccctgtctgtgtctccaggggacagagccaccctctcctgcagggccagt

SEQ ID NO: 9267 - DNA, 78 bp, Artificial Sequence
  Synthetic construct
gaaatagtgctgacgcagtctccagccaccctgtctctgtctccaggggaaagagccaccctctcctgcagggccagt

SEQ ID NO: 9268 - DNA, 78 bp, Artificial Sequence
  Synthetic construct
gaaattgtgttgacgcagtctccaggcaccctgtctttgtctccaggggaaagagccaccctctcctgcaggcccagt

SEQ ID NO: 9269 - DNA, 78 bp, Artificial Sequence
  Synthetic construct
gacatcgtgatgacccagtctccagactccctggctgtgtctctgggcgagagggccaccatctactgcaggtccagc

SEQ ID NO: 9270 - DNA, 78 bp, Artificial Sequence
  Synthetic construct
gacatcgtgatgacccagtctccagactccctgggtgtgtctctgggcgagcgggccaccatcaactgcaagtccagc

SEQ ID NO: 9271 - DNA, 78 bp, Artificial Sequence
  Synthetic construct
gtcatctggatgacccagtctccatccttactctctgcatctacaggagacagagtcaccatcagttgtcggatgagt

SEQ ID NO: 9272 - DNA, 78 bp, Artificial Sequence
  Synthetic construct
gacatcgtgatgacccagtctccagactctctggctgtgtctctgggcgagagggccaccatcaactgcaagtccagc

SEQ ID NO: 9273 - DNA, 78 bp, Artificial Sequence
  Synthetic construct
gccatccggataacccagtctccatcctcactctctgcatctacaggagacagagtcaccatcacttgtcgggcgagt

SEQ ID NO: 9274 - DNA, 78 bp, Artificial Sequence
  Synthetic construct
gacatcgtgatgacccagtctccagactccctggctgtgtctctgggcgagagggccaccatcaactgcaagtccagt

SEQ ID NO: 9275 - DNA, 75 bp, Artificial Sequence
  Synthetic construct
tcctatgagctgacacagccaccctcggtgtcagtgtccccaggacagacggccaggatcacctgctctggagat

SEQ ID NO: 9276 - DNA, 75 bp, Artificial Sequence
  Synthetic construct
tcttctgagctgactcaggaccctggtgtgtctgtggccttgggacagacagtcaggatcacatgccaaggagac

SEQ ID NO: 9277 - DNA, 75 bp, Artificial Sequence
  Synthetic construct
tcctatgtgctgactcagccaccctcggtgtcagtggccccaggacagacggcctacttttcctgtgggggaacc

SEQ ID NO: 9278 - DNA, 75 bp, Artificial Sequence
  Synthetic construct
cagtctgccctgactcagcctgcctccgtgtctgggtctcctggacagtcgatcaccatctcctgcagtggaacc

SEQ ID NO: 9279 - DNA, 75 bp, Artificial Sequence
  Synthetic construct
cagtctgccctgactcagcctgcctccgtgtctgggtctcctggacagtcgatcaccatctgctgcactggaacc

SEQ ID NO: 9280 - DNA, 75 bp, Artificial Sequence
  Synthetic construct
cagtctgccctgactcagtttgcctccgtgtctgggtctcctggacagtcgatcaccatctcctgcactggaacc

SEQ ID NO: 9281 - DNA, 75 bp, Artificial Sequence
  Synthetic construct
cagtctgccctgactcagcctgcctccgtgtctgggtctcctggacagtcgatcaccatttcctgcactggaacc

SEQ ID NO: 9282 - DNA, 75 bp, Artificial Sequence
  Synthetic construct
cagtctgccctgactcagcctgcctccgtgtctgggtttcttggacagtcgatcaccatctcctgcactggaacc

SEQ ID NO: 9283 - DNA, 75 bp, Artificial Sequence
  Synthetic construct
cagtctgccctgactcaggctgcctccgtgtctgggtctcctggacagtcgatcaccatctcctacactggaacc

SEQ ID NO: 9284 - DNA, 78 bp, Artificial Sequence
  Synthetic construct
gacatccagatgacccagtctccatcctccctgtcttcatctgtcggagacagagtcaccatcacttgccaggcgagt

SEQ ID NO: 9285 - DNA, 78 bp, Artificial Sequence
  Synthetic construct
gaagttgtgttgacgcagtctccaggcaccctgtctttgtctccaggggaaagagccaccctctcctgcagggccagt

SEQ ID NO: 9286 - DNA, 78 bp, Artificial Sequence
  Synthetic construct
aaaattgtgttgacgcagtctccagccaccctgtctttgtctccaggggaaagagccaccctctcctgcagggccagt

SEQ ID NO: 9287 - DNA, 78 bp, Artificial Sequence
  Synthetic construct
gaaattgtgttgacacagtctccagccaccctgtctttgtctccaggggaaagagccaccctctcctgcagggccagt

SEQ ID NO: 9288 - DNA, 75 bp, Artificial Sequence
  Synthetic construct
tcttctgagctgactcaggaccctgctgtgtctgtggccttgggacagacagtcaggatcacatgccaaggagac

SEQ ID NO: 9289 - DNA, 75 bp, Artificial Sequence
  Synthetic construct
tcctatgtgctgactcagccaccctcggtgtcagtggccccaggacagacggccaggatgacgtgtgggggaaac

SEQ ID NO: 9290 - DNA, 78 bp, Artificial Sequence
  Synthetic construct
gaaatagtgatgacgcagtctccagccaccctgtctgtgtctccaggggaaagagccaccctctcgtgcagggccagt

SEQ ID NO: 9291 - DNA, 75 bp, Artificial Sequence
  Synthetic construct
cagtctgcgctgactcagtcaccctcagcgtctgagacccccgggcagagggtcaccatctcttgttctggaagc

SEQ ID NO: 9292 - DNA, 78 bp, Artificial Sequence
  Synthetic construct
gatattgtgatgacccagactccactctccctgcccgtcacccctggagagccggcctccatctcctgcaggtctagt

SEQ ID NO: 9293 - DNA, 75 bp, Artificial Sequence
  Synthetic construct
cagtctgccctgactcagcctcgctcagtgtccgggtctcctggacagtcagtcaccatctcctgcactggaacc

SEQ ID NO: 9294 - DNA, 78 bp, Artificial Sequence
  Synthetic construct
gccatccagatgacccagtctccatcctccctgtctgcatctgttggagacagagtcaccatcacttgccgggcaagt

SEQ ID NO: 9295 - DNA, 75 bp, Artificial Sequence
  Synthetic construct
tcctctgaactgacacagccaccctcggtgtcactgtccccaggacagacggccaggatcacctgctctggagat

SEQ ID NO: 9296 - DNA, 75 bp, Artificial Sequence
  Synthetic construct
cagtctgccctgactcagcctccctccgcgtccgggtctcctggacagtcagtcaccatctcctgcactggaacc

SEQ ID NO: 9297 - DNA, 75 bp, Artificial Sequence
  Synthetic construct
agttttattctgactcagccgcactctgtgtcggagtctccggggaaggcggtgaccatctcctgttcccgcagc

SEQ ID NO: 9298 - DNA, 78 bp, Artificial Sequence
  Synthetic construct
gacatccagatgacccagtctccatcctccctgtctgcatctgtgggagacagagtcaccatcacctgccgggcgagt

SEQ ID NO: 9299 - DNA, 78 bp, Artificial Sequence
  Synthetic construct
gacatccagatgacccagtctccttccaccctgtctgcatctgcaggagacagagtcaccatcacttgccgggccagt

SEQ ID NO: 9300 - DNA, 75 bp, Artificial Sequence
  Synthetic construct
cagtctgtactgacgcagccgccctcagtgtctggggccccagggcagagggtcaccatctcctgcactgggagc

SEQ ID NO: 9301 - DNA, 78 bp, Artificial Sequence
  Synthetic construct
gacatcgtgatgacccagtctccagactccctggctgtgtctctgggcgagagggccaccctcaactgcacgtccagt

SEQ ID NO: 9302 - DNA, 78 bp, Artificial Sequence
  Synthetic construct
gaaattgtgttggcgcagtctccaggctccctgactttgtctccaggggaaagagccaccctctcctgcagggccagt

SEQ ID NO: 9303 - DNA, 78 bp, Artificial Sequence
  Synthetic construct
gacatccagatgacccagtctccttccaccctgtctgcttctgtgggagacagactcaccatcacttgccgggccagt

SEQ ID NO: 9304 - DNA, 75 bp, Artificial Sequence
  Synthetic construct
tcctatgaactgacacagccatcctcagtgtcagtgtctccgggacagacagccaggatcacctgctcaggagat

SEQ ID NO: 9305 - DNA, 75 bp, Artificial Sequence
  Synthetic construct
tccttagtgctgactcaacaacccacagtgtcagtggcccccggaaagacggccaccataacctgtggggggacc

SEQ ID NO: 9306 - DNA, 78 bp, Artificial Sequence
  Synthetic construct
gacattatgttgacgcagtctccaggcaccctgtctttgtctccaggggaaagagtcaccctctcctgcagggccagt

SEQ ID NO: 9307 - DNA, 78 bp, Artificial Sequence
  Synthetic construct
gaaatagtgatgacgcagtctccagccatcctgtctgtgtctccaggggacagagccaccctctcctgcagggccagt

SEQ ID NO: 9308 - DNA, 78 bp, Artificial Sequence
  Synthetic construct
gacatccagatgacccagtctccatcctccgtgtctgcttctgtaggagacagagtcaccatcacttgccgggcgagt

SEQ ID NO: 9309 - DNA, 78 bp, Artificial Sequence
  Synthetic construct
gacatccagatgacccagtctccttccaccctgtctgcatctgtaggagaaagagtcaccatcacttgccgggccagc

SEQ ID NO: 9310 - DNA, 75 bp, Artificial Sequence
  Synthetic construct
cagtctgtgctgactcagccaccctcagcatctgggacccccgggcagaggatcaccatctcttgttctggcagc

SEQ ID NO: 9311 - DNA, 75 bp, Artificial Sequence
  Synthetic construct
tcctatgagctgacacagccatcctcagtgtccgtgtctccgggacagacagccaggatcacctgttcaggagat

SEQ ID NO: 9312 - DNA, 75 bp, Artificial Sequence
  Synthetic construct
tcctatgagctgacacagccaccctcggtgtcagtgtccccaggacagacggccaggatcccctgctctggaggt

SEQ ID NO: 9313 - DNA, 78 bp, Artificial Sequence
  Synthetic construct
gacatccagatgacccagtctccttccaccctgtctgcatctgtcggagacagagtcaccatcacttgccgggccagt

SEQ ID NO: 9314 - DNA, 75 bp, Artificial Sequence
  Synthetic construct
cagtctgtgctgacgcagccgccctcagtgtctggggccccagggcacaaggtcaccatctcctgcactgggagc

SEQ ID NO: 9315 - DNA, 78 bp, Artificial Sequence
  Synthetic construct
gaaattgtgatgactcagtctccactctccctgcccgtcgcccctggagagccggcctccatctcctgcacgtctagt

SEQ ID NO: 9316 - DNA, 78 bp, Artificial Sequence
  Synthetic construct
gaaattgtgttgacgcagtctccaggcaccctgtctttgtctccaggggaaactgccaccctctcctgcagggccagt

SEQ ID NO: 9317 - DNA, 75 bp, Artificial Sequence
  Synthetic construct
aattttatgctgactcagccccactctgtgtcggagtctccggggaagacggtaaccatctcctgcacccgcagc

SEQ ID NO: 9318 - DNA, 78 bp, Artificial Sequence
  Synthetic construct
gacatccagatgacccagtctccttccaccctgtctgcatctgtgggagacagagtcaccatcacttgccgggccagt

SEQ ID NO: 9319 - DNA, 75 bp, Artificial Sequence
  Synthetic construct
tcctatgacctgagtcagccaccctcagtgtccgtgtccccacgacagacagccaacatcacctgctctggacat

SEQ ID NO: 9320 - DNA, 78 bp, Artificial Sequence
  Synthetic construct
gaaatagtgatgacgcagtctccagccaccctgtctgtgtctccagggggaagagccaccctcacctgcacggccact

SEQ ID NO: 9321 - DNA, 78 bp, Artificial Sequence
  Synthetic construct
caaattgtgttgacgcagtctccaggcaccctgtctttgtctccaggggaaagagccaccctctcctgcagggccagt

SEQ ID NO: 9322 - DNA, 78 bp, Artificial Sequence
  Synthetic construct
gacatcgtgatgacccagtccccagactccctggctgtgtctctgggcgcgagggccaccatcaactgcaagtctagt

SEQ ID NO: 9323 - DNA, 78 bp, Artificial Sequence
  Synthetic construct
gatgttgtggtcactcagtctccactttccctgcccgtcatccttggacagccggcctccatctcctgcaggtccagt

SEQ ID NO: 9324 - DNA, 78 bp, Artificial Sequence
  Synthetic construct
gacatccagatgacccagtctccatcctccctgtctgcatctgtaggagacagagtcaccatcacttgccaggcgagc

SEQ ID NO: 9325 - DNA, 78 bp, Artificial Sequence
  Synthetic construct
gaaatagtcatgacgcagtctccagccaccctgtctgtgtctccaggggaaagagccaccctctcctgcagggccagt

SEQ ID NO: 9326 - DNA, 75 bp, Artificial Sequence
  Synthetic construct
cagtctgtgcttattcagccaccctcagcgtctgggacccccgggcagagggtctccatcccttgctctgggagc

SEQ ID NO: 9327 - DNA, 78 bp, Artificial Sequence
  Synthetic construct
ggcatcctgttgacccagtctccaccgtccctgtctgcatccgagggagacagagtcaccatcacttgccgggcaaat

SEQ ID NO: 9328 - DNA, 75 bp, Artificial Sequence
  Synthetic construct
cagactgtggtgacccaggagccatcgttctcagtgtcccctggagggacagtcacactcacttgtggcttgacc

SEQ ID NO: 9329 - DNA, 78 bp, Artificial Sequence
  Synthetic construct
gaaattgtgttgacgcagtctccaggcaccctgtctttgtctccaggggaaagcgccaccctctcctgcagggccagt

SEQ ID NO: 9330 - DNA, 78 bp, Artificial Sequence
  Synthetic construct
gaaattgtgttgacgcagtctccaggcaccctgtctttgtctccagggggaagagccggtctctcctgtagggccagt

SEQ ID NO: 9331 - DNA, 78 bp, Artificial Sequence
  Synthetic construct
gaaattgtgctgactcagtctccagactttcaggctgtgactccaaaggagaaagtcaccatcacctgccgggccagt

SEQ ID NO: 9332 - DNA, 78 bp, Artificial Sequence
  Synthetic construct
gaaattgtgttgacacagtctccaggcaccctgtctttgtctccaggggaaagagccaccctctcctgcagggccagt

SEQ ID NO: 9333 - DNA, 78 bp, Artificial Sequence
  Synthetic construct
gccatccagatgacccagtctccatcctccctgtctgcatctgtaggagacagagtcaccatcacttgccgggcaagt

SEQ ID NO: 9334 - DNA, 78 bp, Artificial Sequence
  Synthetic construct
gatattgtgatgacccagactccactctcctcacctgtcacccttggacagccggcctccatctcctgcaggtctagt

SEQ ID NO: 9335 - DNA, 75 bp, Artificial Sequence
  Synthetic construct
aactttatgttgactcagccccactctgtgtcggagtcaccggggaagacggtaaccatctcttgtattcgcggc

SEQ ID NO: 9336 - DNA, 78 bp, Artificial Sequence
  Synthetic construct
gaaatagtgatgacgcagtctccagccaccctgtctgtgtctccaggggatagagccaccctctcctgcagggccagt

SEQ ID NO: 9337 - DNA, 75 bp, Artificial Sequence
  Synthetic construct
tcttatgtgctgactcagccaccctcggtgtcagtggccccaggacagacggccaggattacctgtgggggagac

SEQ ID NO: 9338 - DNA, 75 bp, Artificial Sequence
  Synthetic construct
cagtctgccctgactcagcctcgctcagtgtccggatctcctggacagtcagtcaccatctcctgcactggaacc

SEQ ID NO: 9339 - DNA, 78 bp, Artificial Sequence
  Synthetic construct
gacatcgtggtgacccagtctccagactccctggctgtgtctctgggcgagagggccaccatcaactgcaagtccagc

SEQ ID NO: 9340 - DNA, 78 bp, Artificial Sequence
  Synthetic construct
gacatccagatgacccagtctccatcctccctgtctgcatctgtgggagacagagtcaccatcacttgccgggcgagt

SEQ ID NO: 9341 - DNA, 78 bp, Artificial Sequence
  Synthetic construct
gaaatagtgctgacgcagtctccagccaccctgtctgtgtctccaggggaaagagccaccctctcctgcagggccagt

SEQ ID NO: 9342 - DNA, 78 bp, Artificial Sequence
  Synthetic construct
gacatccagatgacccagtctccgtcctccctgtctgcatctgtaggagacagagtcaccatcacttgccgggcaagt

SEQ ID NO: 9343 - DNA, 78 bp, Artificial Sequence
  Synthetic construct
gatattgtgatgactcagtctccactctccctgcccgtcacccctggagagccggcctccatctcctgcaagtctagt

SEQ ID NO: 9344 - DNA, 75 bp, Artificial Sequence
  Synthetic construct
tcttctgggctgactcaggaccctgttgtgtctgtggccttggggcagacagtcaagatcaaatgccagggtgac

SEQ ID NO: 9345 - DNA, 78 bp, Artificial Sequence
  Synthetic construct
gaaattgtgttgacacagtctccagccaccctgtccttgtctccaggggaaagagccaccctctcctgcagggccagt

SEQ ID NO: 9346 - DNA, 78 bp, Artificial Sequence
  Synthetic construct
gaaagagtgatgacgcagtctccagccaccctgtctgtgtctccaggggaaagagccaccctctcctgcagggccagt

SEQ ID NO: 9347 - DNA, 75 bp, Artificial Sequence
  Synthetic construct
cagtctgtgctgactcagcccccctcaacgtctgggacccccgggcagagggtcaccatctcttgttctgggacc

SEQ ID NO: 9348 - DNA, 75 bp, Artificial Sequence
  Synthetic construct
tcctatgtactgactcagccaccctcggtgtcagtggccccaggacagacggccaagattacctgtgggggaaac

SEQ ID NO: 9349 - DNA, 75 bp, Artificial Sequence
  Synthetic construct
cagtctgtcttgactcagccaccctcagtgtctgggacccccgggcagagggtcaccatgtcttgttctggaagc

SEQ ID NO: 9350 - DNA, 78 bp, Artificial Sequence
  Synthetic construct
gacatccagatgacccagtctccatcctccctgtctgcgtctgtaggagacagagtcaccatcacttgccgggcgagt

SEQ ID NO: 9351 - DNA, 78 bp, Artificial Sequence
  Synthetic construct
gacatccagatgacccagtctccttccaccctgtctgcatctgtaggagacagagtcaccttcacttgccgggccagt

SEQ ID NO: 9352 - DNA, 78 bp, Artificial Sequence
  Synthetic construct
gacatccagatgacccagtctccttccaccctgtctgcatctgtaggagacagagtcaatatcacttgccgggccagt

SEQ ID NO: 9353 - DNA, 75 bp, Artificial Sequence
  Synthetic construct
tactatgtgctgactcagccaccctcggtgtcagtggccccaggacagacggccaggatcacctgcgggggaaac

SEQ ID NO: 9354 - DNA, 75 bp, Artificial Sequence
  Synthetic construct
tcccatgtgctgactcagccaccctcggtgtcagtggccccaggacagacggccaggattacctgtgggggagac

SEQ ID NO: 9355 - DNA, 75 bp, Artificial Sequence
  Synthetic construct
cagcttgtgctgactcaatcgccctctgcctctgcctccctgggagcctcggtcaagctcacctgcactctgagc

SEQ ID NO: 9356 - DNA, 78 bp, Artificial Sequence
  Synthetic construct
gccatccagatgactcagtctccatcctccctgtctgcatctgtaggagacagagtcaccatcacttgccgggcaagt

SEQ ID NO: 9357 - DNA, 75 bp, Artificial Sequence
  Synthetic construct
tcctatgacctgacacagccaccctcggtgtcagtgtccccacgacagacggccacgatcacctgctctggagat

SEQ ID NO: 9358 - DNA, 78 bp, Artificial Sequence
  Synthetic construct
caaattgtgttgacacagtctccagccaccctatctttgtctccaggggaaaaagccaccctctcatgcagggccagt

SEQ ID NO: 9359 - DNA, 78 bp, Artificial Sequence
  Synthetic construct
gaaattgtgttgacacagtctccagccaccctgtctttgtctccgggggaaagagccaccctctcctgcagggccagt

SEQ ID NO: 9360 - DNA, 75 bp, Artificial Sequence
  Synthetic construct
aattttatgctgactcagccctactctgtgtcggagtctccggggaagacggtaaccatctcctgcacccgcagc

SEQ ID NO: 9361 - DNA, 75 bp, Artificial Sequence
  Synthetic construct
tcttctgagctgactcaggaccctgctgtgtctgtggccttgggacagacagtcacgatcacctgccaaggagac

SEQ ID NO: 9362 - DNA, 75 bp, Artificial Sequence
  Synthetic construct
tcctatgtgctgactcagccaccctcagtgtcagtggccccaggaaagacggccaggattacctgtgggggaaac

SEQ ID NO: 9363 - DNA, 75 bp, Artificial Sequence
  Synthetic construct
tcctatgagctgactcagccaccctcagtgtccgtgtccccaggacagacagccagcatcacctgctctggagat

SEQ ID NO: 9364 - DNA, 15 bp, Artificial Sequence
  Synthetic construct
tcctgcactggaacc

SEQ ID NO: 9365 - DNA, 78 bp, Artificial Sequence
  Synthetic construct
gacgtccagatgacccaatctccatcttccgtgtctgcatctgtaggagaccgagtcaccatcacttgtcgggcgagt

SEQ ID NO: 9366 - DNA, 78 bp, Artificial Sequence
  Synthetic construct
gaagttctcttgacacagactccagccaccctgtctttgtctccaggggagagagccaccctctcctgcagggccaat

SEQ ID NO: 9367 - DNA, 78 bp, Artificial Sequence
  Synthetic construct
gccatccagttgacccagtctccatccttcctgtctgcatctgtaggagacagagtcaccatcacttgccgggccagt

SEQ ID NO: 9368 - DNA, 78 bp, Artificial Sequence
  Synthetic construct
aaaatagtgatgacgcagtctccagccaccctgtctgtgtctccaggggagagagccacgctctcctgcagggccagt

SEQ ID NO: 9369 - DNA, 78 bp, Artificial Sequence
  Synthetic construct
gacatccagatgacccagcctccttccaccctgtctgcatctgtaggagacagagtcagcatcacttgccgggccagt

SEQ ID NO: 9370 - DNA, 78 bp, Artificial Sequence
  Synthetic construct
gacatccagatgacccagtctccttccaccctgtctgcatctgtaggggacagaatcaccatcacttgccgggccagt

SEQ ID NO: 9371 - DNA, 75 bp, Artificial Sequence
  Synthetic construct
tcctatgtgctgactcagccaccctcggtgtcagtggccccaggacagacggccagaattacctgtgaggcagac

SEQ ID NO: 9372 - DNA, 78 bp, Artificial Sequence
  Synthetic construct
gacatgcagatgacccagtctccttccaccctgtctgcatttgtaggagacagagtcaccatcacttgccgggccagt

SEQ ID NO: 9373 - DNA, 78 bp, Artificial Sequence
  Synthetic construct
gaattagtgatgacgcagtctccagccaccctgtctgtgtctccaggggagagagccaccctgtcctgcagggccagt

SEQ ID NO: 9374 - DNA, 78 bp, Artificial Sequence
  Synthetic construct
gacatccagatgacccagtctccttccattctgtctgcttctgtaggggatagagtcaccatcacttgccgggccaac

SEQ ID NO: 9375 - DNA, 78 bp, Artificial Sequence
  Synthetic construct
gacatcgtgatgacccagtctccagactccctgcctgtgtctctgggcgagagggccaccatcaactgcaagtccagc

SEQ ID NO: 9376 - DNA, 75 bp, Artificial Sequence
  Synthetic construct
tcttctgagttggcccaggaccctgctgtgtctgtggccttggggcacacagtcacgatcacatgccgaggagac

SEQ ID NO: 9377 - DNA, 75 bp, Artificial Sequence
  Synthetic construct
cagtctgccctgactcagcctgcctccgtgtctgggtctcctggacagtcgatcaccatctcctgcactggaagc

SEQ ID NO: 9378 - DNA, 75 bp, Artificial Sequence
  Synthetic construct
tcttctgagttgactcaggaccctgctgtgtctgtggccttgggacagacagtcaggatcacatgccaaggagac

SEQ ID NO: 9379 - DNA, 78 bp, Artificial Sequence
  Synthetic construct
gaaattgtgatgacgcagtctccagtcacgttgtctgtgtctccgggggaaagagtcgcgctctcctgcagggccagt

SEQ ID NO: 9380 - DNA, 78 bp, Artificial Sequence
  Synthetic construct
gaaattgtgttgacgcagtctccaggcaccctgtctttgtctccagggggaagagccggtctctcctgcagggccagt

SEQ ID NO: 9381 - DNA, 75 bp, Artificial Sequence
  Synthetic construct
ccctatgtgctgacgcagccaccctcggtgtcagtggccccaggacagacggccaggactacctgtgggggaaac

SEQ ID NO: 9382 - DNA, 78 bp, Artificial Sequence
  Synthetic construct
gacatccagatgacccagtctcctttcaccctgtctgcatctgtcggcgacagaatcaccatcacttgccgggccagt

SEQ ID NO: 9383 - DNA, 78 bp, Artificial Sequence
  Synthetic construct
gatattgtgttgacacagtctccagccaccctgtctttgtctccaggagaaagagccaccctctcctgcagggccagt

SEQ ID NO: 9384 - DNA, 78 bp, Artificial Sequence
  Synthetic construct
gaaatagtgatgacgcagtctccagccaccctgtctgtgtctccaggggaaagagccaccctctcctgctgggccagt

SEQ ID NO: 9385 - DNA, 75 bp, Artificial Sequence
  Synthetic construct
cagtctgttttggcgcagccgccctcagtgtctgcggccccaggacagagggtcaccatctcctgctctggaagc

SEQ ID NO: 9386 - DNA, 75 bp, Artificial Sequence
  Synthetic construct
cagtctgtgttgacgcagccgccctcagtgtctgcggccccaggacagaaggtcaccatctcctgctctggaagc

SEQ ID NO: 9387 - DNA, 75 bp, Artificial Sequence
  Synthetic construct
tcctatgtactgactcagccaccctcggtgtcagtggccccaggacagacggccaggattacctgtgggggaagc

SEQ ID NO: 9388 - DNA, 78 bp, Artificial Sequence
  Synthetic construct
gacatccagatgacccagtctccatcctccctgtcagcctctgtaggagacagagtcaccatcacttgccgggcaagt

SEQ ID NO: 9389 - DNA, 78 bp, Artificial Sequence
  Synthetic construct
gagattgtgttgacgcagtctccaggcaccctgtctttgtctccaggtgaccgagccaccatctcctgtagggccagt

SEQ ID NO: 9390 - DNA, 78 bp, Artificial Sequence
  Synthetic construct
gacatccagatgacccagtctccttccaccctgtctgcatctgtaggggacagagtcaccatcacttgccgggccagt

SEQ ID NO: 9391 - DNA, 75 bp, Artificial Sequence
  Synthetic construct
cagcctgtgctgactcaatcatcctctgcctctgcttccctgggatcctcggtcaagctcacctgcactctgagc

SEQ ID NO: 9392 - DNA, 78 bp, Artificial Sequence
  Synthetic construct
gacatcgtgatgacccagtctccagactccctgtctgtgtctctgggcgagagggccaccatcaactgcaagtccagc

SEQ ID NO: 9393 - DNA, 78 bp, Artificial Sequence
  Synthetic construct
gacatccagatgacccagtctccatcctccctgtcggcatctgtaggagacagagtcaccatcacctgccgggcgagt

SEQ ID NO: 9394 - DNA, 78 bp, Artificial Sequence
  Synthetic construct
gtcatccagatgacccagtctccatcctcactgtctgcgtctgtaggagacagcgtcaccatcacttgccgggcgagt

SEQ ID NO: 9395 - DNA, 78 bp, Artificial Sequence
  Synthetic construct
caaattgtgttgacacagtctccagccaccctgtctttgtctccaggggaaagagtcaccctctcctgcagggccagt

SEQ ID NO: 9396 - DNA, 75 bp, Artificial Sequence
  Synthetic construct
caggctgtggtgactcaggagccctcgctgactgtgtcccctggagggacagtcactctcacctgtggctccagc

SEQ ID NO: 9397 - DNA, 75 bp, Artificial Sequence
  Synthetic construct
cagtctgccctgactcagcctgcctccgtgtctgggtctcctggacagtcgatcaccatctcctggaatggaacc

SEQ ID NO: 9398 - DNA, 78 bp, Artificial Sequence
  Synthetic construct
gacatccagatgacccagtctccatcctccctgtctgcatctgtaggagacagagtcaccatcacttgccaggcgagt

SEQ ID NO: 9399 - DNA, 78 bp, Artificial Sequence
  Synthetic construct
gacatccagatgacccagtctccttccaccctgtctgcatctataggagacagagtcaccatcacttgccgggccagc

SEQ ID NO: 9400 - DNA, 78 bp, Artificial Sequence
  Synthetic construct
gacattgtgatgactcagaccccgctctccctgtccgtcacccttggacaggcggcctccttctcctgcacgtctagt

SEQ ID NO: 9401 - DNA, 78 bp, Artificial Sequence
  Synthetic construct
gaaattgtgttgacgcagtctccaggcaccctgtctttgtctccaggggaaagagccagtctctcctgcagggccagt

SEQ ID NO: 9402 - DNA, 75 bp, Artificial Sequence
  Synthetic construct
cagtctgccctgactcagcctacctccgtgtctgggtctcctggacagtcgatcaccatctcctgcactgccacc

SEQ ID NO: 9403 - DNA, 78 bp, Artificial Sequence
  Synthetic construct
tccatcgtgatgacccagtctccagagtccctagatgtgtctctgggcgagagggccaccatccactgcaagtccagc

SEQ ID NO: 9404 - DNA, 78 bp, Artificial Sequence
  Synthetic construct
gaaatagtgttgacgcagtctccagccaccctgtctatgtctccaggggaaagagccaccctctcctgcagggccagt

SEQ ID NO: 9405 - DNA, 78 bp, Artificial Sequence
  Synthetic construct
gaaatagtgatgacgcagtctccagtcaccctgtctgtgtctccaggggaaagagtcaccctctcctgtagggccaat

SEQ ID NO: 9406 - DNA, 75 bp, Artificial Sequence
  Synthetic construct
tcctatgagctgacacagccaccctcggtgtcagtgtccccaggacaaccggccaggatcacctgctctggagat

SEQ ID NO: 9407 - DNA, 78 bp, Artificial Sequence
  Synthetic construct
gacatccagttgacccaatctccatcctccctgtctgcatctgtaggagacagagtcaccatcacttgccaggcgagt

SEQ ID NO: 9408 - DNA, 78 bp, Artificial Sequence
  Synthetic construct
gacatccagatgacccagtctccatcctcactgtctgcatctgtaggagacagagtcaccatcacttgtcgggcgagt

SEQ ID NO: 9409 - DNA, 78 bp, Artificial Sequence
  Synthetic construct
gaaacagtgatgacgcagtctccagccaccctgtctgtgtctccaggggaaagagtcaccctctcctgcagggccagt

SEQ ID NO: 9410 - DNA, 78 bp, Artificial Sequence
  Synthetic construct
gaaattgtgttgacgcagtctcctggcaccctgtctttgtctccaggacaaagagccaccctctcctgcagggccagt

SEQ ID NO: 9411 - DNA, 78 bp, Artificial Sequence
  Synthetic construct
gaagttgtgctgactcagtctccagactttcagtctgtgactccaaaggagaaagtcaccatcacctgccgggccagt

SEQ ID NO: 9412 - DNA, 78 bp, Artificial Sequence
  Synthetic construct
gacatccagatgacccagtctccatcttccgtgtctgcatctgtaggagacagagtcaccattacttgtcgggcgagt

SEQ ID NO: 9413 - DNA, 78 bp, Artificial Sequence
  Synthetic construct
gacatccagatgacccagtctccatcctccctgtctgcatctgtgggagccagagtcaccttcacttgccgggcaagt

SEQ ID NO: 9414 - DNA, 78 bp, Artificial Sequence
  Synthetic construct
gaaattgtgttgacgcagtctccaggcaccctgtctttgtctccaggggaaagagccaccctctcctgcagggccagc

SEQ ID NO: 9415 - DNA, 78 bp, Artificial Sequence
  Synthetic construct
gacatccagatgacccagtctccatctgccatgtctgcatctgtaggagacagagtcaccatcacttgtcgggcgagt

SEQ ID NO: 9416 - DNA, 75 bp, Artificial Sequence
  Synthetic construct
tcctatgacctgactcagccgccctccgtgtccgtgtcccctggacagagagccaccatcacctgctctggagat

SEQ ID NO: 9417 - DNA, 75 bp, Artificial Sequence
  Synthetic construct
tcttctgagctgactcaggaccctgctgtgtctgtggccctgggccagacagtcaggatcgcatgccaaggagac

SEQ ID NO: 9418 - DNA, 78 bp, Artificial Sequence
  Synthetic construct
gacatccagataacccagtctccatcctccctgtctgcatctgtaggagacagagtcaccatcacttgtcgggcgagt

SEQ ID NO: 9419 - DNA, 78 bp, Artificial Sequence
  Synthetic construct
gacatccagatgacccagtctccatcctcactgtctgcatctgtaggagacagagtcaccatgacttgtcgggcgagt

SEQ ID NO: 9420 - DNA, 78 bp, Artificial Sequence
  Synthetic construct
gagattgtgatgacccagactccgctctccttgtctatcacccctggagagcaggcctccatgtcctgcaggtctagt

SEQ ID NO: 9421 - DNA, 78 bp, Artificial Sequence
  Synthetic construct
gacatcgtgatgacccagtctccagactccctggctgtgtctctgggcgaaagggccaccatcaactgcaagtccagc

SEQ ID NO: 9422 - DNA, 75 bp, Artificial Sequence
  Synthetic construct
aattttatactgactcagccccactctgtgtccgagtctccggggaagacggtcaccatctcctgcacccgcagc

SEQ ID NO: 9423 - DNA, 75 bp, Artificial Sequence
  Synthetic construct
cagtctgccctgactcagcctgcctccgtgtctgggtctcctggacagtcgatcaccatatcctgcactggaacc

SEQ ID NO: 9424 - DNA, 78 bp, Artificial Sequence; identical to SEQ ID NO: 1843
  Synthetic construct

SEQ ID NO: 9425 - DNA, 78 bp, Artificial Sequence
  Synthetic construct
gaaattgtattgacgcagtctccaggcaccctgtctttgtctccaggggaaagagccaccctctcctgcagggccagt

SEQ ID NO: 9426 - DNA, 75 bp, Artificial Sequence
  Synthetic construct
cagactgtggtgacccaggagccatcgctctcagtgtcccctggagggacagtcacactcacttgtggcttgagg

SEQ ID NO: 9427 - DNA, 78 bp, Artificial Sequence
  Synthetic construct
gatattgtgatgactcagtctccactctccctgcccgtcaccctaggccagtcggcctccatctcctgcaggtctagt

SEQ ID NO: 9428 - DNA, 75 bp, Artificial Sequence
  Synthetic construct
cagactgtggtgacccaggagccatcgttctcagtgtcccctggagggacagtcacactcacttgtggcttaagc

SEQ ID NO: 9429 - DNA, 75 bp, Artificial Sequence
  Synthetic construct
tcctatgagctgacacagccatcctcagtgtcagtgtctccgggacagacagccaggatcacctgctcaggagat

SEQ ID NO: 9430 - DNA, 78 bp, Artificial Sequence
  Synthetic construct
gatattgtgatgactcagtctccactctccctgcccgtcacccctggagagccggcctccatctcctgcaggtctagt

SEQ ID NO: 9431 - DNA, 78 bp, Artificial Sequence
  Synthetic construct
gacatccagatgacccagtctccatcctccctgtctgcatctataggggacagagtcaccatcacttgccggacaagt

SEQ ID NO: 9432 - DNA, 78 bp, Artificial Sequence
  Synthetic construct
gatgttgtgatgactcagtctccactctccctgcccgtcagccttggacagccggcctccatctcctgcaggcccggt

SEQ ID NO: 9433 - DNA, 75 bp, Artificial Sequence
  Synthetic construct
ccctatgttctgactcagccaccctcggtgtcggtggccccaggacagacggccaggattacctgtgggggaaac

SEQ ID NO: 9434 - DNA, 75 bp, Artificial Sequence
  Synthetic construct
aaatttttgctgacccagccgcactctgtgtcggagtctccggggaagacattaaccatctcctgcacccgcagc

SEQ ID NO: 9435 - DNA, 78 bp, Artificial Sequence
  Synthetic construct
gacatccagatgacccagtctccttcaaccctgtctgcatcgataggagacagagtcagcctcacttgccgggccagt

SEQ ID NO: 9436 - DNA, 78 bp, Artificial Sequence
  Synthetic construct
gaaatagtgatgacgcagtctccaggcaccctgtctgtgtctccaggggacagagtcatcctctcctgcagggccagt

SEQ ID NO: 9437 - DNA, 78 bp, Artificial Sequence
  Synthetic construct
gacatcgtgatgacccagactccagactccctggctgtgtctctgggcgagagggccaccatcaactgcaagtccagc

SEQ ID NO: 9438 - DNA, 75 bp, Artificial Sequence
  Synthetic construct
tcctatgtgctgactcagccaccctcggtgtcagtggccccaggtcagacggccagaattacctgtgagggaacc

SEQ ID NO: 9439 - DNA, 75 bp, Artificial Sequence
  Synthetic construct
cagcctgtgctgactcagccatcttcccattctgcatcttctggagcatcagtcagactcacctgcatggtgagc

SEQ ID NO: 9440 - DNA, 78 bp, Artificial Sequence
  Synthetic construct
gacatccagctgacccagtctccatcttccgtgtctgcctctgtgggagacagagtcaccatgacttgtcggacgagt

SEQ ID NO: 9441 - DNA, 78 bp, Artificial Sequence
  Synthetic construct
gacatcgtgatgacccagtctccagactccctggctgtgtctctgggcgagagggccaccatcaagtgcaagtccagc

SEQ ID NO: 9442 - DNA, 75 bp, Artificial Sequence
  Synthetic construct
agtttcatgctgactcagtctcactctgtgtcggactctccggggaagacagttaccatctcctgcacccgcacc

SEQ ID NO: 9443 - DNA, 75 bp, Artificial Sequence
  Synthetic construct
tcctatgtgctgactcaggcagcctcggtgtcagtcgccctaggacagacggccacaattccctgtgggggagac

SEQ ID NO: 9444 - DNA, 75 bp, Artificial Sequence
  Synthetic construct
tcttctgagctgactcaggaccctgctgtgtctgtggccttgggacagacagtcacgatcacatgtcaaggagac

SEQ ID NO: 9445 - DNA, 78 bp, Artificial Sequence
  Synthetic construct
gacatccagatgacccagtctccttccaccctgtctgcatctgtaggagacagagtcaccatcatttgccgggccagt

SEQ ID NO: 9446 - DNA, 78 bp, Artificial Sequence
  Synthetic construct
gacatccagatgacccagtctccatccaccctgtctgcttctataggagacagagtcatcatcacttgtcgggccagt

SEQ ID NO: 9447 - DNA, 78 bp, Artificial Sequence
  Synthetic construct
ggcatccagatgacccagtctccttccaccctgtctgcatctgtaggagacagagtcaccattacctgccgggccagt

SEQ ID NO: 9448 - DNA, 78 bp, Artificial Sequence
  Synthetic construct
gatgttgtgatgactcagtctccactctccctgcccgtcacccttggacagccggcctccatctcctgcatgtctaat

SEQ ID NO: 9449 - DNA, 78 bp, Artificial Sequence
  Synthetic construct
gacatccagatgacccagtctccatcctccctgtctgcatctgtaggagacacagtcaccatcacttgccgggcaagt

SEQ ID NO: 9450 - DNA, 75 bp, Artificial Sequence
  Synthetic construct
tcttatgagctgacacagccaccctcggtgtcagtgtccccaggacagacggccaagatcacctgctctgcagat

SEQ ID NO: 9451 - DNA, 75 bp, Artificial Sequence
  Synthetic construct
cagtctgtgctgacgcagccgccctcagtgtctggggccccagggcagagggtcaccctttcctgcactgggagc

SEQ ID NO: 9452 - DNA, 78 bp, Artificial Sequence
  Synthetic construct
gacatccagctgacccagtctccatcctccctgtctgcatctgtcggagacagagtcaacatcacttgccggacaagt

SEQ ID NO: 9453 - DNA, 78 bp, Artificial Sequence
  Synthetic construct
gaaattgtgttgacacagtccccaggcaccctgtctttgtctccaggggaaagagccaccctctcctgcagggccagt

SEQ ID NO: 9454 - DNA, 78 bp, Artificial Sequence
  Synthetic construct
gacatccagatgacccagtctccgtcctcactgtctgcatctgttggagacagagtcaccatcacttgtcggtcgagt

SEQ ID NO: 9455 - DNA, 78 bp, Artificial Sequence
  Synthetic construct
gaaatagtgatgacgcagtctccagccatcctgtctgtgtctccaggggaaagagccaccctctcctgcagggccagt

SEQ ID NO: 9456 - DNA, 78 bp, Artificial Sequence
  Synthetic construct
gaaactgtgttgacacagtctccagccaccctgtctttgtctccaggggaaagagccaccctctcctgcagggccagt

SEQ ID NO: 9457 - DNA, 78 bp, Artificial Sequence
  Synthetic construct
gacatccagatgacccagtctccatcttccgtgtctgcatctgtaggagacagagtcaccatcacttgtcgggcgagt

SEQ ID NO: 9458 - DNA, 75 bp, Artificial Sequence
  Synthetic construct
tcctatgtgctgactcagccaccctcggtgtcagtggccccaggacagacggccagcattacctgtgggggaaac

SEQ ID NO: 9459 - DNA, 78 bp, Artificial Sequence
  Synthetic construct
gaaattgtattgacacagtctccagccaccctgtctttgtctccaggggaaagagccaccctctcctgcagggccagt

SEQ ID NO: 9460 - DNA, 78 bp, Artificial Sequence
  Synthetic construct
gccatccagttgacccagtctccatccttcctgtctgcatccgctggagacagagtcaccatcacttgccgggccagt

SEQ ID NO: 9461 - DNA, 78 bp, Artificial Sequence
  Synthetic construct
gaaatagtgatgacgcagtctccagtcagcctgtctgtgtctccaggggaaagagccaccctctcctgcagggccagt

SEQ ID NO: 9462 - DNA, 78 bp, Artificial Sequence
  Synthetic construct
gccatccggatgacccagtctccatcctcactctctgcatcgacaggagacagtgtcaccatcacttgtcgggcgagt

SEQ ID NO: 9463 - DNA, 78 bp, Artificial Sequence
  Synthetic construct
gccgtccggatgacccagtctccttcttccctgtctgcatctacaggagacagagtcacaatcacttgtcgggcgagt

SEQ ID NO: 9464 - DNA, 75 bp, Artificial Sequence
  Synthetic construct
tcatatgcgatgactcagccaccctcagtgtccgtgtccccaggacagacagccagcatcacctgttatggagat

SEQ ID NO: 9465 - DNA, 75 bp, Artificial Sequence
  Synthetic construct
cagtctgccctgactcagcctgcctccgtgtctgggtctcctggacagtcgatctccatctcctgcactggatcc

SEQ ID NO: 9466 - DNA, 75 bp, Artificial Sequence
  Synthetic construct
tatgatgagctggctcagccaccctcactgtccgtgtccccaggacggacagccaccatcacctgctctggagat

SEQ ID NO: 9467 - DNA, 78 bp, Artificial Sequence
  Synthetic construct
gatgttgtgatgactcagtctcccctctccctgcccgtcacccttggacagccggcctccatctcctgcaggtctaat

SEQ ID NO: 9468 - DNA, 78 bp, Artificial Sequence
  Synthetic construct
gacatcgtgatgacccagtctccagactccctggctgtgtctctgggcgagagggccaccatcacctgcaagtccagc

SEQ ID NO: 9469 - DNA, 78 bp, Artificial Sequence
  Synthetic construct
gaaattgtgttgacgcagtctccaggcaccctgtctttgtctccaggggatagagccaccctctcctgcagggccagt

SEQ ID NO: 9470 - DNA, 75 bp, Artificial Sequence
  Synthetic construct
cagactgtggtgacccaggagccatcgctctcagtgtcccctggaggggcagtgacgctcacttgtggcttgagc

SEQ ID NO: 9471 - DNA, 78 bp, Artificial Sequence
  Synthetic construct
gacatccagatgacccagtctccctccaccctgtctgcatctgtgggagacacagtcaccatcacctgccgggccagt

SEQ ID NO: 9472 - DNA, 78 bp, Artificial Sequence
  Synthetic construct
gacatcgtgttgacccagtctccagactccctggctgtgtctctgggcgagagggccaccatcaactgcaagtccagc

SEQ ID NO: 9473 - DNA, 78 bp, Artificial Sequence
  Synthetic construct
gagattgtgatgacccagactccactctccttgtctatcacccctggagagcaggcctccatgtcctgcaggtctagt

SEQ ID NO: 9474 - DNA, 78 bp, Artificial Sequence
  Synthetic construct
gacatccagatgacccagtctccatcttccgtgtctgcatctgtgggagacagagtcaccatcacttgtcgggcgagt

SEQ ID NO: 9475 - DNA, 78 bp, Artificial Sequence
  Synthetic construct
gacatcgtgatgacccagtctccagagtccctggctgtgtctctgggcgagagggccaccatcaactgcaagtccagc

SEQ ID NO: 9476 - DNA, 75 bp, Artificial Sequence
  Synthetic construct
cagtctgccctgactcagcctccctccgcgtccgggtctcctgaacagtcagtcaccatctcctgcactggaacc

SEQ ID NO: 9477 - DNA, 78 bp, Artificial Sequence
  Synthetic construct
gaaatagtgatgacgcagtctccggccatcctgtctgtgtctccaggggaaacagccaccctctcctgcagggccagt

SEQ ID NO: 9478 - DNA, 75 bp, Artificial Sequence
  Synthetic construct
cagtctgtgctgactcagccaccctcagcgtctggtacccccgggcagagggtcaccatctcttgttctggaagc

SEQ ID NO: 9479 - DNA, 75 bp, Artificial Sequence
  Synthetic construct
cagtctgccctgactcagcctgcctccgtgtctgggtctcctggacagtcgatcaccatctcctgcactggaacg

SEQ ID NO: 9480 - DNA, 78 bp, Artificial Sequence
  Synthetic construct
gacatccagatgacccagtctccttccaccctatctgcatctgttggagacagagtcaccatcacctgtcgggccagt

SEQ ID NO: 9481 - DNA, 75 bp, Artificial Sequence
  Synthetic construct
cagtctgccctgactcagcctgcctccgtgtctgggtctcctggacagtcgataaccatctcctgcactggaacc

SEQ ID NO: 9482 - DNA, 78 bp, Artificial Sequence
  Synthetic construct
gacatccagatgacccagtctccatcctcactgtctgcatctgttggagacagagtcaccatcacttgtcgggcgagt

SEQ ID NO: 9483 - DNA, 78 bp, Artificial Sequence
  Synthetic construct
gaaacagtgatgacgcagtctccagccaccctgtctgtgtctccaggggatagagcccccctctcctgcagggccagt

SEQ ID NO: 9484 - DNA, 78 bp, Artificial Sequence
  Synthetic construct
gaaatagtgatgacgcagtctccagccaccctgtctgtgtctgcaggggaaacagccaccctttcctgcagggccagt

SEQ ID NO: 9485 - DNA, 75 bp, Artificial Sequence
  Synthetic construct
cagtctgccctgactcagcctgcctccgtgtttgggtctcctggacagtcgatcaccatctcctgcactggaacc

SEQ ID NO: 9486 - DNA, 78 bp, Artificial Sequence
  Synthetic construct
gacatcgtgatgacccagtctccagactccctggctgtgtctctgggcgagagggccaccatcaactgcaggtccagc

SEQ ID NO: 9487 - DNA, 75 bp, Artificial Sequence
  Synthetic construct
tcctctgtcctgactcagccaccctcggtgtcagtggccccggggcagacggccaggattccctgtgacttaaac

SEQ ID NO: 9488 - DNA, 78 bp, Artificial Sequence
  Synthetic construct
gaaatagtgatgacgcagtctccagccaccctgtctgtgtctccaggggaaggagccgtactctcctgcagggccagt

SEQ ID NO: 9489 - DNA, 78 bp, Artificial Sequence
  Synthetic construct
gaaatagtgatgacgcagtctccagccaccctgtctgtgtctccaggggaaagagtcaccctctcctgcagggccagt

SEQ ID NO: 9490 - DNA, 78 bp, Artificial Sequence
  Synthetic construct
gaaattgtgttgacacagtctccagtcaccctgtctgtgtctccaggggaaagagccaccctctcctgcagggccagt

SEQ ID NO: 9491 - DNA, 78 bp, Artificial Sequence
  Synthetic construct
gaaatagtgatgacgcagtctccagccaccctgtctgtgtctccaggagaaagagccaccctctcctgcagggccagt

SEQ ID NO: 9492 - DNA, 75 bp, Artificial Sequence
  Synthetic construct
cagtctgtgttgacgcagccgccctcagtgtctgcgaccccaggacagaaggtcaccatctcctgctctggaagc

SEQ ID NO: 9493 - DNA, 78 bp, Artificial Sequence; identical to SEQ ID NO: 1842
  Synthetic construct

SEQ ID NO: 9494 - DNA, 78 bp, Artificial Sequence
  Synthetic construct
gacatccagatgaaccagtctccatcttcactgtctgcatctgttggagacagcgtcaccatcacttgtcgggcgagt

SEQ ID NO: 9495 - DNA, 78 bp, Artificial Sequence
  Synthetic construct
gagatcgtcctgacccagtctccagactccctggctgtgtccctgggcgacagggccaccatcacctgcacctccaat

SEQ ID NO: 9496 - DNA, 75 bp, Artificial Sequence
  Synthetic construct
tcctatgagctgactcagccaccctcagtgtccgtgtccccaggacagacagccagcatcacctgtattggagat

SEQ ID NO: 9497 - DNA, 78 bp, Artificial Sequence
  Synthetic construct
gaagttgtgttgacacagtctccagccaccctgtctttgtctccaggggaaagagccaccctctcctgcagggccagt

SEQ ID NO: 9498 - DNA, 78 bp, Artificial Sequence
  Synthetic construct
caaattgtgttgacacagtctccagccaccctgtctttgtctccaggggaaagagccaccctctcctgcagggccagt

SEQ ID NO: 9499 - DNA, 78 bp, Artificial Sequence
  Synthetic construct
gatgttgacctgactcagtctccgctcgtcctgcccgtcgcccttggtcagccggcctccatctcctgcaaggctagt

SEQ ID NO: 9500 - DNA, 78 bp, Artificial Sequence
  Synthetic construct
gacatccagatgacccagtctccatcctccctgtccgcatctgtaggggacaaagtcaccatcacttgccgggcaagt

SEQ ID NO: 9501 - DNA, 75 bp, Artificial Sequence
  Synthetic construct
cagtctgtgttgactcagccaccctcagcgtctgggacccccgggcagagggtctctatttcttgtcatggaagc

SEQ ID NO: 9502 - DNA, 75 bp, Artificial Sequence
  Synthetic construct
caggcagggctgactcagccaccctcggtgtccaagggcttgagacagaccgccacactcacctgcactgggaac

SEQ ID NO: 9503 - DNA, 78 bp, Artificial Sequence
  Synthetic construct
gacatccagatgacccagtctccttccaccctgtctgcatctgttggagacagagtcaccatcacttgccgggccagt

SEQ ID NO: 9504 - DNA, 78 bp, Artificial Sequence
  Synthetic construct
gaaatagtgatgacgcagtctccagccaccctgtcagtgtctccaggggaaagagccaccctctcctgctgggccggt

SEQ ID NO: 9505 - DNA, 78 bp, Artificial Sequence
  Synthetic construct
gacattgtgctgactcagtctccactctccctgcccgtcacccctggagagccggcctccctctcctgcaagtcttcg

SEQ ID NO: 9506 - DNA, 78 bp, Artificial Sequence
  Synthetic construct
gacatccagatgacccagtctccatcttccgtgtctgcatctgttggagacaaagtcaccttcacttgtcgggcgagt

SEQ ID NO: 9507 - DNA, 75 bp, Artificial Sequence; identical to SEQ ID NO: 1845
  Synthetic construct

SEQ ID NO: 9508 - DNA, 78 bp, Artificial Sequence
  Synthetic construct
gacatccagttgacccagtctccatcctccctgtctgcatctgtaggagacagagtcaccatcacttgccgggcaagt

SEQ ID NO: 9509 - DNA, 78 bp, Artificial Sequence
  Synthetic construct
gtcatccggatgacccagtctccatcgtcactctctgcatctacgggagacagagtcaccatcacttgtcgggcgagt

SEQ ID NO: 9510 - DNA, 78 bp, Artificial Sequence
  Synthetic construct
ggcatcgtgatgacccagtctccagactccctgactgtgtctctgggcgagagggccaccatcaactgcaagtccaac

SEQ ID NO: 9511 - DNA, 75 bp, Artificial Sequence
  Synthetic construct
cagtctgtcctgactcagcctccctccgcgtccgggtctcctggacagtcagtcaccatctcctgcactggagcc

SEQ ID NO: 9512 - DNA, 78 bp, Artificial Sequence
  Synthetic construct
gacatcgtgttgacccagtctccagactccctggctgtgtctctgggcgagagggccaccatcagttgcaagtccagt

SEQ ID NO: 9513 - DNA, 78 bp, Artificial Sequence
  Synthetic construct
gacatccagatgacccagtctccttccaccctgtctgcctctgtaggagacagagtcagcatcacttgccgggccagt

SEQ ID NO: 9514 - DNA, 78 bp, Artificial Sequence
  Synthetic construct
gacatccagatgacccagtctccttccaccctgtctgcatcggtaggagacagagtctccatcacttgccgggccagt

SEQ ID NO: 9515 - DNA, 78 bp, Artificial Sequence
  Synthetic construct
gacatccagatgacccagtctccatcctccctgtctgcatctgtaggagacagagtcacgatcacttgccgggcaagt

SEQ ID NO: 9516 - DNA, 75 bp, Artificial Sequence
  Synthetic construct
acctatgtactgactcagccaccctcagtgtcagtggccccaggaatgacggccaggattacctgtgggggagac

SEQ ID NO: 9517 - DNA, 75 bp, Artificial Sequence
  Synthetic construct
cagtctgtgttgacacagccgccctcagtgtctgcgtccccaggacagaaggtcaccatctcctgctctggaacc

SEQ ID NO: 9518 - DNA, 78 bp, Artificial Sequence
  Synthetic construct
aaaattgtgttgacgcagtctccaggcaccctgtctttgtctccaggggaaagagccaccctctcctgcagggccagt

SEQ ID NO: 9519 - DNA, 78 bp, Artificial Sequence
  Synthetic construct
gaaattgtgttgacacagtctccaggcaccctgtctttgtctccaggggaaggagccagcctctcctgcagggccagt

SEQ ID NO: 9520 - DNA, 78 bp, Artificial Sequence; identical to SEQ ID NO: 1841
  Synthetic construct

SEQ ID NO: 9521 - DNA, 78 bp, Artificial Sequence
  Synthetic construct
gagattgtgttgacgcagtcgccaggcaccctgtcggtgactccaggacaaaaagccagcgtctcctgcagggccagt

SEQ ID NO: 9522 - DNA, 78 bp, Artificial Sequence
  Synthetic construct
gacatccagatgacccagtctccatcctccctgtcagcatctgtaggcgacagagtcaccatcacttgccgggcgagt

SEQ ID NO: 9523 - DNA, 78 bp, Artificial Sequence
  Synthetic construct
gacatccagatgacccagtctccatcctccctgtctgcatctgtcggagacagaatcaccatcacttgccgggcaagt

SEQ ID NO: 9524 - DNA, 78 bp, Artificial Sequence
  Synthetic construct
gaaattgtgttgacacagtctccagccaccctgtctttgtctccaggggacagagccaccctctcctgcagggccagt

SEQ ID NO: 9525 - DNA, 75 bp, Artificial Sequence
  Synthetic construct
ccctatgtgctgactcaaccaccctcactgtcagtggccccagggaagacggccaggatttcctgtgggggagac

SEQ ID NO: 9526 - DNA, 75 bp, Artificial Sequence
  Synthetic construct
ctatctgtgttgacgcagccgccctcagtgtctgcggccccaggacagaaggtctccatctcctgctctggaagc

SEQ ID NO: 9527 - DNA, 75 bp, Artificial Sequence
  Synthetic construct
cagtctgtgttgacgcagccgccctccgtgtctgcggccccaggacagaatgtcaccatctcctgctctggaagc

SEQ ID NO: 9528 - DNA, 78 bp, Artificial Sequence
  Synthetic construct
gacatcgtgatgacccagtctccagactccctggctgtgtctctgggcgagcgggccaccatcaactgcaagtccagc

SEQ ID NO: 9529 - DNA, 75 bp, Artificial Sequence
  Synthetic construct
cagtctgtcctgactcagccgccctcagcgtctgggacccccgggctgagggtcaccgtctcttgttctggaagc

SEQ ID NO: 9530 - DNA, 78 bp, Artificial Sequence
  Synthetic construct
gacatccagatgacccagtctccatcctccctgtctgtgtctctaggagaaagagtcaccatcacttgccaggcgagt

SEQ ID NO: 9531 - DNA, 75 bp, Artificial Sequence
  Synthetic construct
cagtctgccctgactcagcctccctccgcgtccgggtctcttggacagtcagtcaccatctcctgcagtggagcc

SEQ ID NO: 9532 - DNA, 78 bp, Artificial Sequence
  Synthetic construct
gaaattgtggtgacgcaatctccaggcaccctgtctttgtctccaggggagagagccaccctctcctgcagggccagt

SEQ ID NO: 9533 - DNA, 78 bp, Artificial Sequence
  Synthetic construct
gaaactgtgttaacgcagtctccagacaccctgtctttgactccaggggaaagagccaccctctcctgcaggcccagt

SEQ ID NO: 9534 - DNA, 75 bp, Artificial Sequence
  Synthetic construct
tcctatgtgctgactcaggcaccctcggtgtcagtggccccaggacagacggccaggattacctgtgggggaaac

SEQ ID NO: 9535 - DNA, 78 bp, Artificial Sequence
  Synthetic construct
gagattgtggtgacccagactccactctccttgtctatcacccctggagagcaggcctccatgtcctgcaggtctagt

SEQ ID NO: 9536 - DNA, 78 bp, Artificial Sequence
  Synthetic construct
gacatcgttgtgacccagtctccagcctccctggctgtgtctctgggcgagagggccaccatcaactgcaagtccact

SEQ ID NO: 9537 - DNA, 78 bp, Artificial Sequence
  Synthetic construct
gacatccagatgacccagtctccatcctccctgtctgcatctgttggagacagagtcaccatcacttgccgggcaagt

SEQ ID NO: 9538 - DNA, 78 bp, Artificial Sequence
  Synthetic construct
gccatccagttgacccagtctccattctccctgtctgcatctgttggagacagagtcaccatcgcttgccgggccagt

SEQ ID NO: 9539 - DNA, 75 bp, Artificial Sequence
  Synthetic construct
cagtctgtggtgacggagccgccctcagtgtctgcggccccaggacagaaggtcaccatctcctgctctggaagc

SEQ ID NO: 9540 - DNA, 75 bp, Artificial Sequence
  Synthetic construct
cagtctgccctgactcagcctgcctccgtgtctgggtctcctggacagtcgatcaccatctcctgcattggaacc

SEQ ID NO: 9541 - DNA, 78 bp, Artificial Sequence
  Synthetic construct
gacatcgagatgacccagtctccatcttccatgtctgcatctgtaggagacagcgtcaccatcacttgtcgggcgagc

SEQ ID NO: 9542 - DNA, 75 bp, Artificial Sequence
  Synthetic construct
cagtctgtggtgactcagccaccctcagcgtctgggacccccgggcagagggtcaccttctcttgttctggaagc

SEQ ID NO: 9543 - DNA, 78 bp, Artificial Sequence
  Synthetic construct
gatattgtgatgacccaggctccactctctctgtccgtcacccctggacaggcggcctccatctcctgcaagtccagt

SEQ ID NO: 9544 - DNA, 75 bp, Artificial Sequence
  Synthetic construct
cagtctgtgttgacgcagtcgccctcagtgtctgcggccccaggacagaaggtcaccatctcctgctctggaggc

SEQ ID NO: 9545 - DNA, 75 bp, Artificial Sequence
  Synthetic construct
cagtctgtgctgactcagccaccctcagcgtctgggacccccgggcagagggtcaccatctcttgttctggaagg

SEQ ID NO: 9546 - DNA, 78 bp, Artificial Sequence
  Synthetic construct
gaaactgtgttgacgcagtctccaggcaccctgtctttgtctccaggggaaagagccgccctctcctgcagggccagt

SEQ ID NO: 9547 - DNA, 78 bp, Artificial Sequence
  Synthetic construct
gaaacgacactcacgcagtccccagcattcatgtcagcgactccaggagacaaagtcaacatctcctgcaaagccacc

SEQ ID NO: 9548 - DNA, 78 bp, Artificial Sequence
  Synthetic construct
gacatccagatgacccagtctccctcctccctgtctgcatctgtaggagacagagtcaccatcacttgccgggcaagt

SEQ ID NO: 9549 - DNA, 78 bp, Artificial Sequence
  Synthetic construct
gacatccagatgacccagtctccatcctccctgtctgcatctgttggagacagtgtcaccgtcacttgccgggcgagt

SEQ ID NO: 9550 - DNA, 75 bp, Artificial Sequence
  Synthetic construct
cagtctgccttgactcagactgcctccgtgtctgggtctcctggacagtcgatcaccatctcctgcactggaacc

SEQ ID NO: 9551 - DNA, 78 bp, Artificial Sequence
  Synthetic construct
gacatccggatgacccagtctccatcctccctgtctgcatctgtgggagacacagtcaccatcacttgccgggcaagt

SEQ ID NO: 9552 - DNA, 75 bp, Artificial Sequence
  Synthetic construct
tcctatgaggtgacacagccaccctcggtgtcagtgtccccaggacagacggccaagatcacctgctctggagat

SEQ ID NO: 9553 - DNA, 78 bp, Artificial Sequence
  Synthetic construct
gacatccagatgacgcagtctccagcctccctgtctgcatctgttggcgacagggtcaccctcacctgccaggcgagt

SEQ ID NO: 9554 - DNA, 75 bp, Artificial Sequence
  Synthetic construct
tcctatgtgctgactcagccaccctcggtgtcagtggccccaggacagacggccaggattacctgtgggggagac

SEQ ID NO: 9555 - DNA, 75 bp, Artificial Sequence
  Synthetic construct
cagtctgccctgactcagcctgcctccgtgtctgggtcgccgggacagtcgatcaccatctcctgcactggaacc

SEQ ID NO: 9556 - DNA, 78 bp, Artificial Sequence
  Synthetic construct
gatgtagtgatgacacagtctccagccaccctgtctgtgtctccaggggaatcagccaccctctcctgcagggccagt

SEQ ID NO: 9557 - DNA, 78 bp, Artificial Sequence
  Synthetic construct
gacatccagatgacccagtctccatcctccctgtctgcgtctgtaggagacagagtcaccatcacttgccgggcaagt

SEQ ID NO: 9558 - DNA, 75 bp, Artificial Sequence
  Synthetic construct
cagtctgttctgacgcagccgccctcagtgtctggggccccaggacagagggtcaccatctcctgcactgggagt

SEQ ID NO: 9559 - DNA, 75 bp, Artificial Sequence
  Synthetic construct
tcttctgagctgactcaggaccctgctatgtctgtggccgtgggacagcaagtcaccatcacatgccacggagac

SEQ ID NO: 9560 - DNA, 78 bp, Artificial Sequence
  Synthetic construct
gacatccagatgacccagtctccctcttccgtgtctgcatctgttggagacagagtcaccatcacttgtcgggcgagt

SEQ ID NO: 9561 - DNA, 78 bp, Artificial Sequence
  Synthetic construct
gaaattgtgctgactcagtctccagactttcagtctgtgactccaaaggagaaagtcaccatcacctgccgggccagt

SEQ ID NO: 9562 - DNA, 78 bp, Artificial Sequence
  Synthetic construct
gacatccagatgacccagtctccttccatcctgtctgcatctgtaggagacagagtcaccatcacttgccgggccagt

SEQ ID NO: 9563 - DNA, 78 bp, Artificial Sequence
  Synthetic construct
gaaattgtgttgacgcagtctccaggcaccttgtctttgtctccaggggacagagccaccctctcctgcagggccagt

SEQ ID NO: 9564 - DNA, 78 bp, Artificial Sequence
  Synthetic construct
gacatccagatgacccagtctccagcctccctgtctgcatctgtgggagacagagtaaccatcacttgccgggcgagt

SEQ ID NO: 9565 - DNA, 75 bp, Artificial Sequence
  Synthetic construct
cagcctgtcctgactcagccaccttcctcctccgcatctcctggagaatccgccagactcacctgcaccttgccc

SEQ ID NO: 9566 - DNA, 78 bp, Artificial Sequence
  Synthetic construct
gacatccagatgacccagtctccatcctccctgtctgcgtctgtaggagacagagtcagcatcacttgccaggcgagt

SEQ ID NO: 9567 - DNA, 78 bp, Artificial Sequence
  Synthetic construct
gacattcagatgacccagtctccatcttccgtgtctgcatctgtaggagacagggtcaccatctcttgtcgggcgagt

SEQ ID NO: 9568 - DNA, 78 bp, Artificial Sequence
  Synthetic construct
gaaattgtgttgacacagtctccagtcaccctgtctttgtctccaggggaaagagccaccctctcctgcagggccagt

SEQ ID NO: 9569 - DNA, 75 bp, Artificial Sequence
  Synthetic construct
cagtctgtgttgacgcagccgccctcagtgtctgcggccccaggacaggaggtcaccatctcctgctctggaaac

SEQ ID NO: 9570 - DNA, 36 bp, Artificial Sequence
  Synthetic construct
cagtctgccctgactcagcctgcctccgtgtccggg

SEQ ID NO: 9571 - DNA, 75 bp, Artificial Sequence
  Synthetic construct
tcctatgtgctgactcagccaccctcagtgtcagtggccccaggaaagacggccaggattacctgtggaggaaac

SEQ ID NO: 9572 - DNA, 75 bp, Artificial Sequence
  Synthetic construct
cagtctgtgctgactcagccaccctcagcgtctgggacccccgggcagagggtcaccgtctcttgctctggaagc

SEQ ID NO: 9573 - DNA, 75 bp, Artificial Sequence
  Synthetic construct
cagtctgtgctgacgcagccgccctcagtgtccggggccgcagggcagagggtcaccatctcctgcactgggagc

SEQ ID NO: 9574 - DNA, 75 bp, Artificial Sequence
  Synthetic construct
cagtctgtggtgactcagccaccctcagtgtctgggacccccggacagagggtctccatctcttgttctggaagc

SEQ ID NO: 9575 - DNA, 78 bp, Artificial Sequence
  Synthetic construct
gacatccagatgacccagtctccatcctccctgtctgcatctataggagacagagtcaccatcacttgccgggcaagt

SEQ ID NO: 9576 - DNA, 75 bp, Artificial Sequence
  Synthetic construct
tcctatgtgctgactcagccaccctcggtgtcagtggccccaggacagacggccaggatcacctgtgggggaaac

SEQ ID NO: 9577 - DNA, 75 bp, Artificial Sequence
  Synthetic construct
cagtctgtgttgacgcagccgccctcagtgtctgcggccccaggacagaaggtcaccatctcctgctctggaaac

SEQ ID NO: 9578 - DNA, 75 bp, Artificial Sequence
  Synthetic construct
cagtctgccctgactcagcctgcctccgtgtctgggtctcctggacactcgatcaccatctcctgcactggaacc

SEQ ID NO: 9579 - DNA, 78 bp, Artificial Sequence
  Synthetic construct
gaaagtgtgttgacgcagtctccaggcaccctgtctgtgtctccaggggaaagagccaccctctcctgcagggccagt

SEQ ID NO: 9580 - DNA, 78 bp, Artificial Sequence
  Synthetic construct
gacattgtgatgactcagacccctcgcgccctgaccgtcagtccgggcgagccggcctccatctcctgcaggtccagc

SEQ ID NO: 9581 - DNA, 78 bp, Artificial Sequence
  Synthetic construct
gacatccagctgacccagtctccatcctccctgcctgcgtctattggagacacagtcaccatcacttgccgggcgagt

SEQ ID NO: 9582 - DNA, 78 bp, Artificial Sequence
  Synthetic construct
aatattgtgatgactcagtctccattttccctgtccgtcacccctggagaggcggcctccatctcctgcaggtctagt

SEQ ID NO: 9583 - DNA, 78 bp, Artificial Sequence
  Synthetic construct
gacatccagatgacccagtctccatcctccctgtctgcatttgttggagacagagtcaccatcacttgccaggcgagt

SEQ ID NO: 9584 - DNA, 75 bp, Artificial Sequence
  Synthetic construct
cagtctgccctgactcaggctgcctccgtgtctgggtctcctggacagtcgatcaccatctcctgcactggaacc

SEQ ID NO: 9585 - DNA, 78 bp, Artificial Sequence
  Synthetic construct
gccatccggataacccagtctccatcctcactctctgcatctacaggaggcagagtcaccatcacttgtcgggcgagt

SEQ ID NO: 9586 - DNA, 78 bp, Artificial Sequence
  Synthetic construct
gacatcgtgatgacccagtctccagcctccctggctgtgtctctgggcgagagggccaccatcaactgcaagtccagc

SEQ ID NO: 9587 - DNA, 78 bp, Artificial Sequence
  Synthetic construct
gccatccggatgactcagtctccatcctcactctctgcatctacaggagacagagtcaccatcacttgtcgggcgagt

SEQ ID NO: 9588 - DNA, 78 bp, Artificial Sequence
  Synthetic construct
gacatccagatgacccagtctccatctgccatatctgcatctgttggagacagagtcaccatcacttgtcgggcgagt

SEQ ID NO: 9589 - DNA, 78 bp, Artificial Sequence
  Synthetic construct
gaaatagtgatgacgcagtctctagccaccctgtctgtgtctcgaggggaaagagccaccctctcctgcagggccagt

SEQ ID NO: 9590 - DNA, 75 bp, Artificial Sequence
  Synthetic construct
cagcttgtgctgagtcaatcgccctctgcctctgcctccctgggagcctcggtcaaactcacctgcactctgagc

SEQ ID NO: 9591 - DNA, 75 bp, Artificial Sequence
  Synthetic construct
cagtctgtgctgacgcagccgccctcagtgtctggggccccagggcagagggtcaccatctcctgcaatgggagc

SEQ ID NO: 9592 - DNA, 78 bp, Artificial Sequence
  Synthetic construct
gccatccagttgacccagtctccatcctccctgtctgcatctgttggagacagagtcaccatcacttgccgggcaagt

SEQ ID NO: 9593 - DNA, 75 bp, Artificial Sequence
  Synthetic construct
cagactgtggtgactcaggagccctcactgactgtgtccccaggagggacagtcactctcacctgtgcttccagc

SEQ ID NO: 9594 - DNA, 78 bp, Artificial Sequence
  Synthetic construct
gacatccagatgacccagtctccttccaccctgtctccatctgtaggagacagagtcactatcacttgtcgggccagt

SEQ ID NO: 9595 - DNA, 78 bp, Artificial Sequence
  Synthetic construct
ggcatccagatgacccagtctccttcctccctgtctgcatctgttggagacagagtcaccatcacttgccaggcgagt

SEQ ID NO: 9596 - DNA, 78 bp, Artificial Sequence
  Synthetic construct
gacttccagatgacccagtctccatcctccctgtctgcatctgtaggagacagaatcaccatctcttgccgggcaact

SEQ ID NO: 9597 - DNA, 78 bp, Artificial Sequence
  Synthetic construct
gacatccagatgacccagtctccttccgccctgtctgcatctgtaggagacagagtcaccatcacttgccgggccagt

SEQ ID NO: 9598 - DNA, 78 bp, Artificial Sequence
  Synthetic construct
gacatccagatgacccagtctccatcctccctgtctgcttctgtaggcgaaagagtcaccatcacttgccgggcgagt

SEQ ID NO: 9599 - DNA, 78 bp, Artificial Sequence
  Synthetic construct
gacatccagatgacccagtctccatcctccctgtctgcatctgtaggagacagagtcaccatcacttgccgggcaggt

SEQ ID NO: 9600 - DNA, 78 bp, Artificial Sequence
  Synthetic construct
gaaattgtgttgacacagtctccagccaccctgtctttgtctccaggggagagagccaccctctcatgcagggccagt

SEQ ID NO: 9601 - DNA, 75 bp, Artificial Sequence
  Synthetic construct
tccgatgaactgactcagccaccctcagtgtccgtgtccccagggcagacagccaccatcacctgctctggagat

SEQ ID NO: 9602 - DNA, 78 bp, Artificial Sequence
  Synthetic construct
gacatcgtgatgacccagtctcctgactccctggctgtgtctctgggcgagagggccaccatcaactgcaggtccagc

SEQ ID NO: 9603 - DNA, 75 bp, Artificial Sequence
  Synthetic construct
cagtctgttttgactcagccaccctcagcgtctgggacccccggacagagggtcaccatctcttgttctggaagc

SEQ ID NO: 9604 - DNA, 75 bp, Artificial Sequence
  Synthetic construct
cagtctgtattgacgcagccgccctcagtgtctgcggccccaggacagaaggtcaccatctcctgctctggaaac

SEQ ID NO: 9605 - DNA, 78 bp, Artificial Sequence
  Synthetic construct
gccatccagttgacccagtctccctcctccctgtctgcatctgtgggagacagagtcaccatcacttgccgggccagt

SEQ ID NO: 9606 - DNA, 78 bp, Artificial Sequence
  Synthetic construct
gacatccagatgacccagtctccatcctccctgtctgcatctgtaggagacagagtcaccctcacttgccgggcaagt

SEQ ID NO: 9607 - DNA, 78 bp, Artificial Sequence
  Synthetic construct
gatattgtgttgacgcagtctcccggcaccctgtctttgtctccaggggaaagagccaccctctcctgcagggccagt

SEQ ID NO: 9608 - DNA, 78 bp, Artificial Sequence
  Synthetic construct
gacatccagatgacccagtctccttccaccctgtctgcttctgtaggagacagagtcaccatcacttgccgggccagt

SEQ ID NO: 9609 - DNA, 78 bp, Artificial Sequence
  Synthetic construct
gacatccagatgacccagtctccatcctccctgtctgcatctgtaggagacagagtcaccatcgcttgccgggcaagt

SEQ ID NO: 9610 - DNA, 75 bp, Artificial Sequence
  Synthetic construct
cagtctgttctgacgcagccgccctcagtgtctggggccccagggcagagggtcaccatctcctgcattgggagc

SEQ ID NO: 9611 - DNA, 78 bp, Artificial Sequence
  Synthetic construct
gacatccagatgacccagtctccatcctccctgtctgcgtctgtaggagacacagtcaccatcacttgccgggcaagt

SEQ ID NO: 9612 - DNA, 78 bp, Artificial Sequence
  Synthetic construct
gaagtagtgctgacgcagtctccagcctccctgtctctggctccaggggaaagagccaccctctcttgcagggccagt

SEQ ID NO: 9613 - DNA, 78 bp, Artificial Sequence
  Synthetic construct
gatgttgtgatgactcagtctccactctccctgcccgtcacccttggacagccggccttcatctcctgcaggtccagt

SEQ ID NO: 9614 - DNA, 49 bp, Artificial Sequence
  Synthetic construct
ggggtctttgtctccaggggaaagggccaccctctcctgcagggccagt

SEQ ID NO: 9615 - DNA, 75 bp, Artificial Sequence
  Synthetic construct
cagtctgtcctgactcagcctgcctccgtgtctgggtctcctggacagtcgatcaccatctcctgctctggatcc

SEQ ID NO: 9616 - DNA, 75 bp, Artificial Sequence
  Synthetic construct
tcctatgtcctgactcagccaccgtcggtgtcagtggccccaggacagacggccagactttcctgtgggggcgac

SEQ ID NO: 9617 - DNA, 78 bp, Artificial Sequence
  Synthetic construct
gacatcgtgatgacccagtctccagaatttctggctgtgtctctgggcgagagggcctccatcaactgcaagtccagc

SEQ ID NO: 9618 - DNA, 75 bp, Artificial Sequence
  Synthetic construct
tcctatgtactgactcagccaccctcagtgtccgcggccccaggaaagacggccaggattacctgtgggggaaac

SEQ ID NO: 9619 - DNA, 78 bp, Artificial Sequence
  Synthetic construct
gccatccggatgacccagtctccatcctcactctctgcatctacaggagacagagtcaccgtcacttgtcgcgcgagt

SEQ ID NO: 9620 - DNA, 78 bp, Artificial Sequence
  Synthetic construct
gacatccaaatgacccagtctccatcctccctgtctgcatctgtaggagacagagtcaccatcacttgccgggcaagt

SEQ ID NO: 9621 - DNA, 78 bp, Artificial Sequence
  Synthetic construct
gaaatagtgatgacgcagtctccagccaccctgtttgtgtctccagggcaaagagtcaccctctcctgcagggccagt

SEQ ID NO: 9622 - DNA, 75 bp, Artificial Sequence
  Synthetic construct
cagtctgccctgactcagtctgcctccgtgtctgggtctcctggacagtcgatcaccatctcctgcactggaacc

SEQ ID NO: 9623 - DNA, 75 bp, Artificial Sequence
  Synthetic construct
tcctatgagctgactcagccacactcagtgtcagtggccacagcacagatggccaagatcacctgtgggggaaac

SEQ ID NO: 9624 - DNA, 75 bp, Artificial Sequence
  Synthetic construct
tcctatgtgttgactcagccaccctcagtgtcagtggccccaggaaagacggccaggattccctgtgggggacag

SEQ ID NO: 9625 - DNA, 75 bp, Artificial Sequence
  Synthetic construct
cagtctgtgttgacgcagccgccctcagtgtctggggccccagggcagagggtcaccctctcctgcactgggagc

SEQ ID NO: 9626 - DNA, 78 bp, Artificial Sequence
  Synthetic construct
gatattgtgatgacccagactccactctctctgtccgtcacccctggacagccggcctccatctcctgcaagtctagt

SEQ ID NO: 9627 - DNA, 75 bp, Artificial Sequence
  Synthetic construct
cagtctgtgctgactcagccaccctcagcgtctgggacccccgggctgagggtcaccatctcttgttctggaagc

SEQ ID NO: 9628 - DNA, 75 bp, Artificial Sequence
  Synthetic construct
cagtctgccctgactcagcctgcctccgtgtctgggtctcctggacagtcggtcaccatctcctgcactggaacc

SEQ ID NO: 9629 - DNA, 75 bp, Artificial Sequence
  Synthetic construct
cagtctgtgctgactcagccaccctcagcgtctggggcccccgggcagagggtcatcgtttcttgttctggcagc

SEQ ID NO: 9630 - DNA, 78 bp, Artificial Sequence
  Synthetic construct
gacatccagatgacccagtctccatcctccctgtctgcatctgtgggagacagagtcaccatcacctgccggacaagt

SEQ ID NO: 9631 - DNA, 75 bp, Artificial Sequence
  Synthetic construct
tcctttgagttgacacagccaccctcggtgtcagtgtctccaggacagacggccaggatcacctgctctggagat

SEQ ID NO: 9632 - DNA, 75 bp, Artificial Sequence
  Synthetic construct
cagtctgccctgactcagcctgcctccgtgtctgggtctcctgggcagtcgatcaccatttcctgcaatggatcc

SEQ ID NO: 9633 - DNA, 75 bp, Artificial Sequence
  Synthetic construct
tcccatgagctgacacagccaccctcggtgtcagtttccccaggagagacggccaagatcacctgctctggagat

SEQ ID NO: 9634 - DNA, 75 bp, Artificial Sequence
  Synthetic construct
cagtctgtgttgacgcagccgccctcagtgtctgcggccccaggacagaaggtcaccatgtcctgctctggaagg

SEQ ID NO: 9635 - DNA, 78 bp, Artificial Sequence
  Synthetic construct
gacatccagatgacccagtctccatctttcctgtctgcatctgtgggggacagagtcaccatcacttgccgggcaagt

SEQ ID NO: 9636 - DNA, 75 bp, Artificial Sequence
  Synthetic construct
cagtctgccctgactcagcctgcctccgtgtctgggtctcctggacagtcgatcaccctctcctgcactgggacc

SEQ ID NO: 9637 - DNA, 75 bp, Artificial Sequence; identical to SEQ ID NO: 1846
  Synthetic construct

SEQ ID NO: 9638 - DNA, 75 bp, Artificial Sequence
  Synthetic construct
tcctatgttgtgactcagccaccctcggtgtcggtggccccaggacagacggccatgattccctgtggggcatac

SEQ ID NO: 9639 - DNA, 78 bp, Artificial Sequence
  Synthetic construct
gagattgttttgacgcagtctccaggcaccctgtctttgtctccaggggaacgagccaccctctcttgcacggccagt

SEQ ID NO: 9640 - DNA, 78 bp, Artificial Sequence
  Synthetic construct
gacatccagatgacccagtctccctcttccctgtctgcatctgtgggagacagagtcaccatcacttgccgggcgagt

SEQ ID NO: 9641 - DNA, 78 bp, Artificial Sequence
  Synthetic construct
gagattgtgttgactcagtctccaggcaccctgtctttgtctccaggggaaacagccaccctctcctgcagggccagt

SEQ ID NO: 9642 - DNA, 75 bp, Artificial Sequence
  Synthetic construct
tcctctgtgctgactcagccaccctcggtgtcagtgccccccggacagacggccaggattacctgtgggggaagc

SEQ ID NO: 9643 - DNA, 75 bp, Artificial Sequence
  Synthetic construct
cagtctgccctgactcaacctgcctccgtgtctgggtctcctgaacagtcgatcaccatcgcctgcaccggaagc

SEQ ID NO: 9644 - DNA, 75 bp, Artificial Sequence
  Synthetic construct
cagtctgtgctgacgcagccgccctcagtgtctggggccccagggcagaaggtcaccatctcctgcactgggagc

SEQ ID NO: 9645 - DNA, 78 bp, Artificial Sequence
  Synthetic construct
aacgtccagatgacccagtctccttccaccctgtctgcatctgtaggagacagagtcaccatcacttgccgggccagt

SEQ ID NO: 9646 - DNA, 51 bp, Artificial Sequence
  Synthetic construct
ttagcctggtaccagcagaaacctggccaggctcccaggctcctcatctat

SEQ ID NO: 9647 - DNA, 51 bp, Artificial Sequence
  Synthetic construct
ttggcctggtatcagcaaaaaccagggaaagcccctaacctcctcatctat

SEQ ID NO: 9648 - DNA, 51 bp, Artificial Sequence
  Synthetic construct
gtctcctggttccaacatcacccaggcaaagcccccaaactcataatttat

SEQ ID NO: 9649 - DNA, 51 bp, Artificial Sequence
  Synthetic construct
ttagcctggtatcagcagagatcagggaaagcccctaagcttctgctgtat

SEQ ID NO: 9650 - DNA, 51 bp, Artificial Sequence
  Synthetic construct
gtagcctggtaccagcagaaacctggccagcctcccagactcctcatctct

SEQ ID NO: 9651 - DNA, 51 bp, Artificial Sequence
  Synthetic construct
ccctactggttccagcagaagcctggccaagcccccaggacactgatttat

SEQ ID NO: 9652 - DNA, 51 bp, Artificial Sequence
  Synthetic construct
gtcgcctggtaccaacaacaccctgataaagcccccaaggtcataattttt

SEQ ID NO: 9653 - DNA, 51 bp, Artificial Sequence
  Synthetic construct
ttagcctggtatcagcagacacctggccaggctcccaggctccttatatat

SEQ ID NO: 9654 - DNA, 51 bp, Artificial Sequence
  Synthetic construct
ttggcctggtatcagcagaaaccagggaaagccccgaggatcttgatctat

SEQ ID NO: 9655 - DNA, 51 bp, Artificial Sequence
  Synthetic construct
gtctcctggtaccaacagcacccaggcaaagcccccaaactcataatttat

SEQ ID NO: 9656 - DNA, 51 bp, Artificial Sequence
  Synthetic construct
ttatcttggttccagcagaagccaggacagcctcctaagttgctcatttac

SEQ ID NO: 9657 - DNA, 51 bp, Artificial Sequence
  Synthetic construct
gtttattggtaccaacagaagccaggccaggcccctgaattggtgatgttt

SEQ ID NO: 9658 - DNA, 51 bp, Artificial Sequence
  Synthetic construct
ttagcctggtaccaacacaagcctggccaggctcccagactcctcatctat

SEQ ID NO: 9659 - DNA, 51 bp, Artificial Sequence
  Synthetic construct
ttaacttggtaccaacagaagccagggcagcctcctaagaaactcatttcc

SEQ ID NO: 9660 - DNA, 51 bp, Artificial Sequence
  Synthetic construct
ttagcctggtaccagcagaaacctggccaggctcccacgctcctcatttat

SEQ ID NO: 9661 - DNA, 51 bp, Artificial Sequence
  Synthetic construct
gtctcctggtaccaacaaaacccaggcaaagcccccaaactcatgatttat

SEQ ID NO: 9662 - DNA, 51 bp, Artificial Sequence
  Synthetic construct
ttagcttggtaccagcagaaaccaggacagcctcctaaactgctcactaaa

SEQ ID NO: 9663 - DNA, 51 bp, Artificial Sequence
  Synthetic construct
gtacactggtaccagcagcttccaggaacagcccccaaactcctcatctat

SEQ ID NO: 9664 - DNA, 51 bp, Artificial Sequence
  Synthetic construct
gtctcctggtaccaacaacacccaggcaaagcccccaaactcatgatttct

SEQ ID NO: 9665 - DNA, 51 bp, Artificial Sequence
  Synthetic construct
ttagcttggtaccagcagaaaccagggcagcctcctaagttgctcatttac

SEQ ID NO: 9666 - DNA, 51 bp, Artificial Sequence
  Synthetic construct
tcaagctggttccagcagaagccaggacaggcccctgttcttgtcatcttt

SEQ ID NO: 9667 - DNA, 51 bp, Artificial Sequence
  Synthetic construct
gtgcagtggtaccagcagcgcccgggcagtgcccccaccactgtgatctat

SEQ ID NO: 9668 - DNA, 51 bp, Artificial Sequence
  Synthetic construct
ctagcttggtaccagcagaagccaagacagcctcctaagttactcatcacc

SEQ ID NO: 9669 - DNA, 51 bp, Artificial Sequence
  Synthetic construct
ttacactggtaccagcacaaaccagatcagtctccaaaactgctcatcaag

SEQ ID NO: 9670 - DNA, 51 bp, Artificial Sequence
  Synthetic construct
ttagcctggtaccagcagaaacctggccaggctcccacgctcctcatctac

SEQ ID NO: 9671 - DNA, 51 bp, Artificial Sequence
  Synthetic construct
ttagcctggtaccagcagaaacctggccagcctcccaggctcctcatctat

SEQ ID NO: 9672 - DNA, 51 bp, Artificial Sequence
  Synthetic construct
ttaagttggtatcagcagaaacgtggccaggctcccaggctcgtcatctat

SEQ ID NO: 9673 - DNA, 51 bp, Artificial Sequence
  Synthetic construct
gtccactggtaccagcagaggccaggccaggcccctagactggtcgtcaaa

SEQ ID NO: 9674 - DNA, 51 bp, Artificial Sequence
  Synthetic construct
gtcaactggtaccagcagctcccaggagcggcccccaagctcctcatctat

SEQ ID NO: 9675 - DNA, 51 bp, Artificial Sequence
  Synthetic construct
ttaaattggtatcagcaaaaaccaggaaaagcccccttgctcctgatctat

SEQ ID NO: 9676 - DNA, 51 bp, Artificial Sequence
  Synthetic construct
gtctcccgctaccagcagcacccaggcaaagcccccaaagtcatgatttat

SEQ ID NO: 9677 - DNA, 51 bp, Artificial Sequence
  Synthetic construct
ttctattggtacctgcagaagccaggccagtctccacagctcctaatctat

SEQ ID NO: 9678 - DNA, 51 bp, Artificial Sequence
  Synthetic construct
ttagcctggtatcagcaaaaaccagggaaagcccctaagctcctgatctat

SEQ ID NO: 9679 - DNA, 51 bp, Artificial Sequence
  Synthetic construct
gcttattggtaccaacagaagccaggccaggcccctgtattggtgatatat

SEQ ID NO: 9680 - DNA, 51 bp, Artificial Sequence
  Synthetic construct
gtatactggtaccagcagctcccaggaacggcccccaaactcctcatctat

SEQ ID NO: 9681 - DNA, 51 bp, Artificial Sequence
  Synthetic construct
ttggcctggtatcagcagaaacctgggaaagcccctaaactcctgatctat

SEQ ID NO: 9682 - DNA, 51 bp, Artificial Sequence
  Synthetic construct
gtctcctggttccaacaacacccaggcaaagcccccaaactcattatttat

SEQ ID NO: 9683 - DNA, 51 bp, Artificial Sequence
  Synthetic construct
ttagcctggtatcagcaaaaaccagggaaagcccctaaggtcctgatccat

SEQ ID NO: 9684 - DNA, 51 bp, Artificial Sequence
  Synthetic construct
gtggactggtaccagcagagaccagggaagggcccccggtttgtgatgcga

SEQ ID NO: 9685 - DNA, 51 bp, Artificial Sequence
  Synthetic construct
ttagcctggtatcagcaaaaaccagggaaagcccctaaactcctgatctac

SEQ ID NO: 9686 - DNA, 51 bp, Artificial Sequence
  Synthetic construct
ttagcttggtaccagcagaaaccaggacagcctcctaagctgctcatttac

SEQ ID NO: 9687 - DNA, 51 bp, Artificial Sequence
  Synthetic construct
ttgaattggtttcagcagaggccaggccaatctccaaggcgcctaatttat

SEQ ID NO: 9688 - DNA, 51 bp, Artificial Sequence; identical to SEQ ID NO: 1850
  Synthetic construct

SEQ ID NO: 9689 - DNA, 51 bp, Artificial Sequence
  Synthetic construct
gtctcctggtaccaacaacacccgggcaaagcccccaaggtcctgatttat

SEQ ID NO: 9690 - DNA, 51 bp, Artificial Sequence
  Synthetic construct
gtacactggttccagcagcttccagggacagcccccaaactcctcatttat

SEQ ID NO: 9691 - DNA, 51 bp, Artificial Sequence
  Synthetic construct
gtctcctggtaccaacaacacccaggcaaagcccccaaactcatgatttat

SEQ ID NO: 9692 - DNA, 51 bp, Artificial Sequence
  Synthetic construct
gtgcactggtaccagcagaagccaggccaggcccctgtgctggtcgtctat

SEQ ID NO: 9693 - DNA, 51 bp, Artificial Sequence
  Synthetic construct
ttaaactggtaccaacaaaaacctggccaggctcccaggctcctcatctat

SEQ ID NO: 9694 - DNA, 51 bp, Artificial Sequence
  Synthetic construct
ttagcctggtaccagcagaaacctggacaggctcccaggctcctcatctat

SEQ ID NO: 9695 - DNA, 51 bp, Artificial Sequence
  Synthetic construct
gtcgcttggcttcagcagcggccagggaagggccctcgattcttgatgacg

SEQ ID NO: 9696 - DNA, 51 bp, Artificial Sequence
  Synthetic construct
gtacactggtaccagcaacttccaggaacagcccccaaactcctcatctat

SEQ ID NO: 9697 - DNA, 51 bp, Artificial Sequence
  Synthetic construct
ttagcctggtatcagcagaaacatggccaggctcccaggctcctcatctat

SEQ ID NO: 9698 - DNA, 51 bp, Artificial Sequence
  Synthetic construct
ttagtctggtaccaacagaaacctggccaggctcccaggctcctcatctat

SEQ ID NO: 9699 - DNA, 51 bp, Artificial Sequence
  Synthetic construct
ctagcctggtaccaacaaaagcctggccaggctcccaggctcctcatcttt

SEQ ID NO: 9700 - DNA, 51 bp, Artificial Sequence
  Synthetic construct
ctgagttggtttcaccagaggccaggccgagctccagggcgcctaatttat

SEQ ID NO: 9701 - DNA, 51 bp, Artificial Sequence
  Synthetic construct
gtctcctggtaccaaaaccacccaggcaaagcccccaaagtcttgatttat

SEQ ID NO: 9702 - DNA, 51 bp, Artificial Sequence
  Synthetic construct
ttagcttggtaccagcagaagccagggcggccacctaagttactcatttac

SEQ ID NO: 9703 - DNA, 51 bp, Artificial Sequence
  Synthetic construct
ttagcctggtaccaacagaaacctggccaggctcccaggctcctcatctat

SEQ ID NO: 9704 - DNA, 51 bp, Artificial Sequence
  Synthetic construct
ttaggctggtatcagcagaaaccagggaaagcccctaagcgcctgatctat

SEQ ID NO: 9705 - DNA, 51 bp, Artificial Sequence
  Synthetic construct
gtgaattggtatcaacagaaacctggccagcctcccaggctcctcatctat

SEQ ID NO: 9706 - DNA, 51 bp, Artificial Sequence
  Synthetic construct
ttgaattggtttcagcagaggccaggccaatctccaaggcgccttatttat

SEQ ID NO: 9707 - DNA, 51 bp, Artificial Sequence
  Synthetic construct
ttaaattggtatcagcacaaaccagggaaaccccctaccctcctgatctac

SEQ ID NO: 9708 - DNA, 51 bp, Artificial Sequence
  Synthetic construct
ttaagttggtatcagcagagaccagggaaagcccctaagctcctgatctcc

SEQ ID NO: 9709 - DNA, 51 bp, Artificial Sequence
  Synthetic construct
ctagcctggtatcagcagagaccagggaaagcccctaaactcctgctctat

SEQ ID NO: 9710 - DNA, 51 bp, Artificial Sequence
  Synthetic construct
ttaggctggtaccaacaaaaacctggccaggctcccagtctcctcatctat

SEQ ID NO: 9711 - DNA, 51 bp, Artificial Sequence
  Synthetic construct
ttaaattggtatcagcagaaaccagggaaagcccctaaactcctgatctat

SEQ ID NO: 9712 - DNA, 51 bp, Artificial Sequence
  Synthetic construct
ttaagttggtatcagaagaaaccagggacagcccctaagctcctgatctat

SEQ ID NO: 9713 - DNA, 51 bp, Artificial Sequence
  Synthetic construct
ttaaattggtatcagcagaaaccagggaaagcccctaagctcctgatctat

SEQ ID NO: 9714 - DNA, 51 bp, Artificial Sequence
  Synthetic construct
ttacattggtatcagcagaaaccagggagcgcccctaaactcctgatctat

SEQ ID NO: 9715 - DNA, 51 bp, Artificial Sequence
  Synthetic construct
ttaaattggtatcaacagaagccaggggaagcccctaacgtcctgatctac

SEQ ID NO: 9716 - DNA, 51 bp, Artificial Sequence
  Synthetic construct
ttatcctggtaccaacaaaaacctggccaggctcccagactcctcatctat

SEQ ID NO: 9717 - DNA, 51 bp, Artificial Sequence
  Synthetic construct
ttagcctggtaccagcagaagcttggccaggctcccaggctcctcttcttt

SEQ ID NO: 9718 - DNA, 51 bp, Artificial Sequence
  Synthetic construct
ctgaactggtatcagcagaagcccggagaggcccctaaactgctgatctac

SEQ ID NO: 9719 - DNA, 51 bp, Artificial Sequence
  Synthetic construct
ttggcctggtatcagcagaaaccagggaaagcccctaaactcctgatttat

SEQ ID NO: 9720 - DNA, 51 bp, Artificial Sequence
  Synthetic construct
atagcctggtaccaacaaaaacctggccaggctcccaggctcctcatctat

SEQ ID NO: 9721 - DNA, 51 bp, Artificial Sequence
  Synthetic construct
ttagcctggtaccagcagaaacctggccaggctcccaagctcctcatctct

SEQ ID NO: 9722 - DNA, 51 bp, Artificial Sequence
  Synthetic construct
ttagcctggtaccagcagaaacctggccaggctcccaggctcctcatctct

SEQ ID NO: 9723 - DNA, 51 bp, Artificial Sequence
  Synthetic construct
ttggcctggtatcagcagaaaccagggaaagcccctaagctcctgatctat

SEQ ID NO: 9724 - DNA, 51 bp, Artificial Sequence
  Synthetic construct
ttagcctggtaccagcagaaacctggccaggctcccaggctcgtcatccat

SEQ ID NO: 9725 - DNA, 51 bp, Artificial Sequence
  Synthetic construct
ctagcttggtaccagcagaaatcaggacagcctcctaagctgctcctttac

SEQ ID NO: 9726 - DNA, 51 bp, Artificial Sequence
  Synthetic construct
ctagcttggtaccagcagagaccacgacagtctcctagactgctcatttac

SEQ ID NO: 9727 - DNA, 51 bp, Artificial Sequence
  Synthetic construct
ttagcctggtatcagcaaaaaccagggaaagcccctgagctcctgatctat

SEQ ID NO: 9728 - DNA, 51 bp, Artificial Sequence
  Synthetic construct
ttagcttggtaccagcacaaaccaggacagcctcctaagctgctcgtttac

SEQ ID NO: 9729 - DNA, 51 bp, Artificial Sequence
  Synthetic construct
ttagcttggtttcagcagaaaccaggccagcctcctaagctgctcatttcc

SEQ ID NO: 9730 - DNA, 51 bp, Artificial Sequence
  Synthetic construct
acttattggtaccagcagaagccaggccaggcccctgtgctgatgatatat

SEQ ID NO: 9731 - DNA, 51 bp, Artificial Sequence
  Synthetic construct
gcaagttggtaccaacagaaaccaagacaggcccctctacttgtcatctat

SEQ ID NO: 9732 - DNA, 51 bp, Artificial Sequence
  Synthetic construct
gcttattggtaccagcagaagccaggccaggcccctgtgatgatgatatat

SEQ ID NO: 9733 - DNA, 51 bp, Artificial Sequence
  Synthetic construct
gtgcactggtaccagcagaagccaggccaggcccctctggtggtcgtctat

SEQ ID NO: 9734 - DNA, 51 bp, Artificial Sequence
  Synthetic construct
gtctcctggtaccaacaaaatccagacaaagcccccaaactcatgatttat

SEQ ID NO: 9735 - DNA, 50 bp, Artificial Sequence
  Synthetic construct
gtctcctggtaccaacaaaacccagccaagcccccaaactcatgatttat

SEQ ID NO: 9736 - DNA, 51 bp, Artificial Sequence
  Synthetic construct
gtctcctggtaccaacaaaacccaggcaaagcccccaaactcatgatttct

SEQ ID NO: 9737 - DNA, 51 bp, Artificial Sequence
  Synthetic construct
gtctcctggtaccaacaaaacccaggcaaagcccccaaactcatggtttct

SEQ ID NO: 9738 - DNA, 50 bp, Artificial Sequence
  Synthetic construct
gtctcctggtaccaacaaaacccaggcaaagcccccaaattatgatttat

SEQ ID NO: 9739 - DNA, 50 bp, Artificial Sequence
  Synthetic construct
gtctcctggtaccaacaaaacccagccaagcccccaaactcattatttat

SEQ ID NO: 9740 - DNA, 51 bp, Artificial Sequence
  Synthetic construct
ttaaattggtttcagcaaaaaccagggcaagcccctaagctcctgatctac

SEQ ID NO: 9741 - DNA, 51 bp, Artificial Sequence
  Synthetic construct
ttagcctggtaccagcagaaacccggccaggctcccaggctcctcatctat

SEQ ID NO: 9742 - DNA, 51 bp, Artificial Sequence
  Synthetic construct
ttggcttggtaccagcagaaaccaggacagtctcctaaactgctcatttcc

SEQ ID NO: 9743 - DNA, 51 bp, Artificial Sequence
  Synthetic construct
ttggcctggtaccagcagaaacctggccaggctcccaggctcctcatctac

SEQ ID NO: 9744 - DNA, 51 bp, Artificial Sequence
  Synthetic construct
ttagcctggtatcaggaaaaacctggccaggttcccaggctcctcatctat

SEQ ID NO: 9745 - DNA, 51 bp, Artificial Sequence
  Synthetic construct
gcaagctggtaccagcagaagccaggacaggcccctgtacttgtcatctat

SEQ ID NO: 9746 - DNA, 51 bp, Artificial Sequence
  Synthetic construct
gtgcactggtaccagcagaagccaggccaggtccctgtgctggtcgtctat

SEQ ID NO: 9747 - DNA, 51 bp, Artificial Sequence
  Synthetic construct
ttagcctggcaccagcagaaacctggccaggctcccaggctcctcatctat

SEQ ID NO: 9748 - DNA, 51 bp, Artificial Sequence
  Synthetic construct
gtgtattggtatcagcagttcccaggaaaggccccccaactcctcatcttt

SEQ ID NO: 9749 - DNA, 51 bp, Artificial Sequence
  Synthetic construct
ttagcctggtatcaacagaaacgtggccaggctcccaggctcctcatctat

SEQ ID NO: 9750 - DNA, 51 bp, Artificial Sequence
  Synthetic construct
ttggactggtacctgcagaagccagggcagtctccacagctcctgatctat

SEQ ID NO: 9751 - DNA, 51 bp, Artificial Sequence
  Synthetic construct
gtctcctggtaccaacagcacccaggcaaagcccccaaactcatgatttat

SEQ ID NO: 9752 - DNA, 51 bp, Artificial Sequence
  Synthetic construct
ttaggctggtatcagcagaaaccagggcaggcccctaagttcctgatctct

SEQ ID NO: 9753 - DNA, 51 bp, Artificial Sequence
  Synthetic construct
gtctattggtaccagcagaagccgggccgggcccctatcttggtaatctat

SEQ ID NO: 9754 - DNA, 51 bp, Artificial Sequence
  Synthetic construct
ttagcctggtatcagcagaaaccagggaaagcccctaaggtcctactctat

SEQ ID NO: 9755 - DNA, 51 bp, Artificial Sequence
  Synthetic construct
ttagcctggtatcagcagaaaccagggaatccccctaagcgcctgatcttt

SEQ ID NO: 9756 - DNA, 51 bp, Artificial Sequence
  Synthetic construct
ttggcctggtatcagcagaaaccagggaaagcccctaaactcctcatctat

SEQ ID NO: 9757 - DNA, 51 bp, Artificial Sequence
  Synthetic construct
gtacactggtaccagcagcttccagggacagcccccaaactcctcatcttt

SEQ ID NO: 9758 - DNA, 51 bp, Artificial Sequence
  Synthetic construct
ttagcttggtaccagcagaaaccaggacagcctcctaatttgctcatttac

SEQ ID NO: 9759 - DNA, 51 bp, Artificial Sequence
  Synthetic construct
ttagcctggtaccagcagaagtctggccaggctcccaggctcctcatctat

SEQ ID NO: 9760 - DNA, 32 bp, Artificial Sequence
  Synthetic construct
acccaggcaaagcccccaaagtcttgatttat

SEQ ID NO: 9761 - DNA, 51 bp, Artificial Sequence
  Synthetic construct
ttggcctggtatcagcaaaaaccagggaaagcccctaacctcctgatctat

SEQ ID NO: 9762 - DNA, 51 bp, Artificial Sequence
  Synthetic construct
tctcggtggttccagcagaagccaggccaggcccctgtgctggtgatttat

SEQ ID NO: 9763 - DNA, 51 bp, Artificial Sequence
  Synthetic construct
gtacactggtaccaacagaagccaggccaggcccctgtcgtgctcctctat

SEQ ID NO: 9764 - DNA, 51 bp, Artificial Sequence
  Synthetic construct
ttagcctggtacatcctgaaacctggccagactcccaggctcctcatcttt

SEQ ID NO: 9765 - DNA, 51 bp, Artificial Sequence
  Synthetic construct
ttggcctggtaccagcagaaacttggccagcctcccaggctcctcatcttt

SEQ ID NO: 9766 - DNA, 51 bp, Artificial Sequence
  Synthetic construct
ttagcctggtatcagcagaaaccagggcagggtcctgaactcctcatctat

SEQ ID NO: 9767 - DNA, 51 bp, Artificial Sequence
  Synthetic construct
ttagcctggtaccagcagaaacctggccaggctcccaggcttctcatttat

SEQ ID NO: 9768 - DNA, 51 bp, Artificial Sequence
  Synthetic construct
ttggcctggtatcagcacaagccagggaaagcccctaggctcatgatctat

SEQ ID NO: 9769 - DNA, 51 bp, Artificial Sequence
  Synthetic construct
gtaaactggtaccagcagctcccaggaacgccccccaaactcctcatgttt

SEQ ID NO: 9770 - DNA, 51 bp, Artificial Sequence
  Synthetic construct
gctcggtggttccagcaaaagccaggccaggcccctgtattggtgatttct

SEQ ID NO: 9771 - DNA, 51 bp, Artificial Sequence
  Synthetic construct
gcttattggtaccagcggaagccaggccaggcccctcgactggtgatctat

SEQ ID NO: 9772 - DNA, 51 bp, Artificial Sequence
  Synthetic construct
ttggcctggtatcagcagaaagcagggcaagcccctaagctcctgatctat

SEQ ID NO: 9773 - DNA, 51 bp, Artificial Sequence
  Synthetic construct
gtaaactggtaccaacaacttccaggagaagtccccaaactcctcatttat

SEQ ID NO: 9774 - DNA, 51 bp, Artificial Sequence
  Synthetic construct
ttagattggtacctggtgaagcctggacagcctccacaactcctcatttac

SEQ ID NO: 9775 - DNA, 51 bp, Artificial Sequence
  Synthetic construct
ttggcctggtaccaacagaaacctggccagcctcccaggctcctcatctat

SEQ ID NO: 9776 - DNA, 51 bp, Artificial Sequence
  Synthetic construct
ttggcctggtatcagcagaaaccagggaaagcccctaaactcctgatctat

SEQ ID NO: 9777 - DNA, 51 bp, Artificial Sequence
  Synthetic construct
ttggcctggtatcagcagagaccagggaaagcccctaagctcctgatctat

SEQ ID NO: 9778 - DNA, 51 bp, Artificial Sequence
  Synthetic construct
gcttcctggtatcaacagaagccaggccagtcccctgttctggtcatctat

SEQ ID NO: 9779 - DNA, 51 bp, Artificial Sequence
  Synthetic construct
ttagcctggtaccagcagaaacctggccaggctcccaggctcctcatttat

SEQ ID NO: 9780 - DNA, 51 bp, Artificial Sequence
  Synthetic construct
ttagcctggtaccaccacaaacctggccaggctcccaggctcctcatctat

SEQ ID NO: 9781 - DNA, 51 bp, Artificial Sequence
  Synthetic construct
gtcgcttggtaccagcacaaaacagggcagcctcctaagttgctcatttac

SEQ ID NO: 9782 - DNA, 51 bp, Artificial Sequence
  Synthetic construct
ttgagttggtttcaccagaggccaggccagtctccacggcgcctcatttat

SEQ ID NO: 9783 - DNA, 51 bp, Artificial Sequence
  Synthetic construct
ttagcctggtaccagcaaaaacctggccaggctcccaggctcctcatccac

SEQ ID NO: 9784 - DNA, 51 bp, Artificial Sequence
  Synthetic construct
gttctgtggtatcaacaattcccaggagtggcccccaaactcctcatctac

SEQ ID NO: 9785 - DNA, 51 bp, Artificial Sequence
  Synthetic construct
ttaaattggtatcaacaaaaagcagggaaagcccctaagctcctgatctct

SEQ ID NO: 9786 - DNA, 51 bp, Artificial Sequence
  Synthetic construct
cccagctggtaccagcagaccccaggccaggctccacgcacgctcatctac

SEQ ID NO: 9787 - DNA, 51 bp, Artificial Sequence
  Synthetic construct
ttggcctggtatcagcagaaaccagggaaagcccctaacctcctaatttat

SEQ ID NO: 9788 - DNA, 51 bp, Artificial Sequence
  Synthetic construct
ttagcctggtaccagcagagacctggccaggctcccaggctcctcatctat

SEQ ID NO: 9789 - DNA, 51 bp, Artificial Sequence
  Synthetic construct
ttacactggtaccagcagaaaccagatcagtctccaaagctcctcatcaag

SEQ ID NO: 9790 - DNA, 51 bp, Artificial Sequence
  Synthetic construct
ttagcctggtatcaacaaaaacctggccaggctcccaggctcctcatctct

SEQ ID NO: 9791 - DNA, 51 bp, Artificial Sequence
  Synthetic construct
ttaggctggtatcagcagaaaccagggaaagcccctaagctcctgatctat

SEQ ID NO: 9792 - DNA, 51 bp, Artificial Sequence
  Synthetic construct
ttgagttggcttcagcagaggccaggccagcctccaagactcctaatttat

SEQ ID NO: 9793 - DNA, 51 bp, Artificial Sequence
  Synthetic construct
gcttattggtaccagcagaagccaggccaggcccctgtgctggtgatatat

SEQ ID NO: 9794 - DNA, 51 bp, Artificial Sequence
  Synthetic construct
ttaggctggtatcagcagaaaccagggaaagcccctaggctcctgatctat

SEQ ID NO: 9795 - DNA, 51 bp, Artificial Sequence
  Synthetic construct
gtgcagtggttccaactgcgcccgggcagtgtccccaccactgtgatctat

SEQ ID NO: 9796 - DNA, 51 bp, Artificial Sequence
  Synthetic construct
ttagcctggtaccagcacaaacctggccaggctcccaggctcctcatctat

SEQ ID NO: 9797 - DNA, 51 bp, Artificial Sequence
  Synthetic construct
ttgcactggtaccagcagaagccaggccaggcccctgttttggtcgtctat

SEQ ID NO: 9798 - DNA, 51 bp, Artificial Sequence
  Synthetic construct
gtctcctggtaccaacaccacccaggcaaagcccccaaactcatgatttat

SEQ ID NO: 9799 - DNA, 51 bp, Artificial Sequence
  Synthetic construct
ttaaattggtatcagctcagaccgggggaagcccctaacctcctgatccat

SEQ ID NO: 9800 - DNA, 51 bp, Artificial Sequence
  Synthetic construct
ttagcctggtaccagcagagacatggccaggctcccaggctcctcatctat

SEQ ID NO: 9801 - DNA, 51 bp, Artificial Sequence
  Synthetic construct
ttaggctggtatcagcaaaaaccagggaatgcccctaagcgcctgatctac

SEQ ID NO: 9802 - DNA, 51 bp, Artificial Sequence
  Synthetic construct
ttggcttggtacctgcagaggccagggcagtctccacagctcctaatctac

SEQ ID NO: 9803 - DNA, 51 bp, Artificial Sequence
  Synthetic construct
ttaaattggtatcagcagaaaccagggaaagcccctaagttcctgatctat

SEQ ID NO: 9804 - DNA, 51 bp, Artificial Sequence
  Synthetic construct
aaaacctggctccaacagaggcctggacaggcccctcgacttgtcctctac

SEQ ID NO: 9805 - DNA, 51 bp, Artificial Sequence
  Synthetic construct
ttagcctggtaccagcagaaacctggccagggtcccaggctcctcatctat

SEQ ID NO: 9806 - DNA, 51 bp, Artificial Sequence
  Synthetic construct
ttagcctggtatcagcagaaaccaggcaaagttcctaagctcctgatctat

SEQ ID NO: 9807 - DNA, 51 bp, Artificial Sequence
  Synthetic construct
ttagtctggtatcaacagaaacctgggaaagttcctaagctcctgatttat

SEQ ID NO: 9808 - DNA, 51 bp, Artificial Sequence
  Synthetic construct
gcaagttggtaccagcagaagccaggacaggcccctgtgtttgtcatctat

SEQ ID NO: 9809 - DNA, 51 bp, Artificial Sequence
  Synthetic construct
gtgaactggtaccagcacctcccaggaacggcccccaaactcctcatcttt

SEQ ID NO: 9810 - DNA, 51 bp, Artificial Sequence
  Synthetic construct
gtccactggtaccagcagaagccaggccaggcccctgtgctcgtcgtcttt

SEQ ID NO: 9811 - DNA, 51 bp, Artificial Sequence
  Synthetic construct
gtaaactggtatcagcaagtcccaggatcggcccccaaagtcctcatgtat

SEQ ID NO: 9812 - DNA, 51 bp, Artificial Sequence
  Synthetic construct
ttagcctggtatcagcagacaccagggaaagttccaaagctcctgatctac

SEQ ID NO: 9813 - DNA, 51 bp, Artificial Sequence
  Synthetic construct
ttggcctggtatcagcagaaaccagggaaagcccctaacctcctcatctat

SEQ ID NO: 9814 - DNA, 51 bp, Artificial Sequence
  Synthetic construct
gtgcactggtaccaccagaagccaggccaggcccctgtgctggtcgtctat

SEQ ID NO: 9815 - DNA, 51 bp, Artificial Sequence
  Synthetic construct
atcgcatggcatcagcagcagccagagaagggccctcggtacttgatgaag

SEQ ID NO: 9816 - DNA, 51 bp, Artificial Sequence
  Synthetic construct
ttagcctggtatcagcagaaaccagggaaagttcctaagctcctgatctat

SEQ ID NO: 9817 - DNA, 46 bp, Artificial Sequence
  Synthetic construct
ggggtatcagcaagtcccaggatcggcccccaaagtcctcatgtat

SEQ ID NO: 9818 - DNA, 51 bp, Artificial Sequence
  Synthetic construct
ttgaattggtatcagcagagacccgggaaagcccctcaactcctgatctat

SEQ ID NO: 9819 - DNA, 51 bp, Artificial Sequence
  Synthetic construct
gtttcttggtaccagcagaaggcaggccaggcccctgtgttggtgatatat

SEQ ID NO: 9820 - DNA, 51 bp, Artificial Sequence
  Synthetic construct
ttaaattggtatcagcagaagccagggaaagcccctaagctcctgatctat

SEQ ID NO: 9821 - DNA, 51 bp, Artificial Sequence
  Synthetic construct
ttaggctggtatcagaagaagccagggaaagcccctaagctcctgatctat

SEQ ID NO: 9822 - DNA, 51 bp, Artificial Sequence
  Synthetic construct
ttagcctggcaccaacagaaacctggccaggctcccaggctcctcatctat

SEQ ID NO: 9823 - DNA, 51 bp, Artificial Sequence
  Synthetic construct
ttagcctggtaccaacagaggcctggccaggctccccggctcctcatctat

SEQ ID NO: 9824 - DNA, 51 bp, Artificial Sequence
  Synthetic construct
ccaagctggtaccagcagaagccaggacaggcccctgtacttgtcatctat

SEQ ID NO: 9825 - DNA, 51 bp, Artificial Sequence
  Synthetic construct
gtgcagtggtaccagcagcgcccgggcagtgcccccaccacagtgatctat

SEQ ID NO: 9826 - DNA, 51 bp, Artificial Sequence
  Synthetic construct
gcaacctggtaccagcagaggccaggacaggcccccatacttgtcctctat

SEQ ID NO: 9827 - DNA, 51 bp, Artificial Sequence
  Synthetic construct
gcttgctggtatcagcagaagccaggccagtcccctgtgctggtcatctat

SEQ ID NO: 9828 - DNA, 51 bp, Artificial Sequence
  Synthetic construct
ttggcctggtatcagcagaaaccagggaaaacccctaagctcctgatctat

SEQ ID NO: 9829 - DNA, 51 bp, Artificial Sequence
  Synthetic construct
gtagcctggtatcagcagaaagcagggaaagcccccaagctcctgatctct

SEQ ID NO: 9830 - DNA, 51 bp, Artificial Sequence
  Synthetic construct
ttagtctggtaccaacagaaacctggccaggctcccagggtcgtcatctct

SEQ ID NO: 9831 - DNA, 51 bp, Artificial Sequence
  Synthetic construct
ttagcctggtaccagcagaagcctggccaggctcccaggctcctcatctat

SEQ ID NO: 9832 - DNA, 51 bp, Artificial Sequence
  Synthetic construct
ttggcctggtatcagcagagaccagggaaagcccctaaagtcctgatctat

SEQ ID NO: 9833 - DNA, 51 bp, Artificial Sequence
  Synthetic construct
gtgcactggtaccagcagaagtcaggccaggcccctgtggtggtcgtgtat

SEQ ID NO: 9834 - DNA, 51 bp, Artificial Sequence
  Synthetic construct
ttggcctggtatcagcacaaaccagggacagcccctattctcctaatttat

SEQ ID NO: 9835 - DNA, 51 bp, Artificial Sequence
  Synthetic construct
gtaaactggtaccagcagctcccaggaacggcccccaaactcctcatctat

SEQ ID NO: 9836 - DNA, 51 bp, Artificial Sequence
  Synthetic construct
ttagcctggtaccagcagatacctggccaggctcccaggctcctcatctat

SEQ ID NO: 9837 - DNA, 51 bp, Artificial Sequence
  Synthetic construct
ttggcttggtatcagcagaaaccgggaaaaggccctagtctcctaatatat

SEQ ID NO: 9838 - DNA, 51 bp, Artificial Sequence
  Synthetic construct
ttagcttggtatcagcaaagaccaggacagcctcctaacctcctcatttac

SEQ ID NO: 9839 - DNA, 51 bp, Artificial Sequence
  Synthetic construct
gagagttggtaccgacagaagccgggacaagccccactcactgtcctgtat

SEQ ID NO: 9840 - DNA, 51 bp, Artificial Sequence
  Synthetic construct
gcaacgtggtaccaacagaagccaggacaggcccctgtacttgtcatgtat

SEQ ID NO: 9841 - DNA, 51 bp, Artificial Sequence
  Synthetic construct
ttagcctggtaccagcaaaaacctggccaggctcccacactcctcatctat

SEQ ID NO: 9842 - DNA, 51 bp, Artificial Sequence
  Synthetic construct
gtacactggtaccagcaccttccaggaacagcccccaaactcctcatctat

SEQ ID NO: 9843 - DNA, 51 bp, Artificial Sequence
  Synthetic construct
gtgcactggtaccagcagaagccaggccaggcccctgtgttggtcctctct

SEQ ID NO: 9844 - DNA, 51 bp, Artificial Sequence
  Synthetic construct
ttggcctggtttcagcagaaaccagggaaagcccctaaactcctgatctat

SEQ ID NO: 9845 - DNA, 51 bp, Artificial Sequence
  Synthetic construct
ttagcctggtaccaacagaaacctggccagtctcccagattcctcatctat

SEQ ID NO: 9846 - DNA, 51 bp, Artificial Sequence
  Synthetic construct
ttagcctggtaccagcacaaatctggccggcctcccaggctcctcatctat

SEQ ID NO: 9847 - DNA, 51 bp, Artificial Sequence
  Synthetic construct
gtatcctggtaccagcagttcccaggaacagcccccaaactcctcatttat

SEQ ID NO: 9848 - DNA, 51 bp, Artificial Sequence
  Synthetic construct
gtctcctggtatcagcaactcccaggaaaagccccccgactcctaatttat

SEQ ID NO: 9849 - DNA, 51 bp, Artificial Sequence
  Synthetic construct
gtgcactggtaccggcagaggtcaggccaggcccctgtactggtcgtctat

SEQ ID NO: 9850 - DNA, 51 bp, Artificial Sequence
  Synthetic construct
ttaaattggtatcggcagaaaccagggaaagcccctaagctcctcatctat

SEQ ID NO: 9851 - DNA, 51 bp, Artificial Sequence
  Synthetic construct
ttggcctggtatcaacaaaaacctggccagtctcccaccctcctcatctat

SEQ ID NO: 9852 - DNA, 51 bp, Artificial Sequence
  Synthetic construct
gtctcctggtaccaacaacacccaggcaaagcccccaaagtcatgatttat

SEQ ID NO: 9853 - DNA, 51 bp, Artificial Sequence
  Synthetic construct
atcgcatggcatcagcagcagccagggaaggcccctcggtacttgatgaaa

SEQ ID NO: 9854 - DNA, 51 bp, Artificial Sequence
  Synthetic construct
ttagcttggtatcagcagaaaccaggacagcctcctaagcttctccttaac

SEQ ID NO: 9855 - DNA, 51 bp, Artificial Sequence
  Synthetic construct
ttggcctggtatcagcaaaaaccagggaaagcccctaagctcctgatctat

SEQ ID NO: 9856 - DNA, 51 bp, Artificial Sequence
  Synthetic construct
ttagcctggtatcagcagaaaccagggaaggcccctaacctcctgatctat

SEQ ID NO: 9857 - DNA, 51 bp, Artificial Sequence
  Synthetic construct
ttagcctggtttcagcagaaaccagggagagcccctaagtccttgatctct

SEQ ID NO: 9858 - DNA, 51 bp, Artificial Sequence
  Synthetic construct
ctggcctggtatcagcagaaaccggggaaagcccctaaactcctgatctct

SEQ ID NO: 9859 - DNA, 51 bp, Artificial Sequence
  Synthetic construct
ttagcctggtaccaacagaaacctggccaggctcccagcctcctcatcttt

SEQ ID NO: 9860 - DNA, 51 bp, Artificial Sequence
  Synthetic construct
ccctactggttccagcagaaacctggccaagcccccaggactctaatttat

SEQ ID NO: 9861 - DNA, 51 bp, Artificial Sequence
  Synthetic construct
gtctcctggtaccaacaaaacccaggcaaagcccccaaagtcatgatttat

SEQ ID NO: 9862 - DNA, 51 bp, Artificial Sequence
  Synthetic construct
ttaaattggtatcagcagaaaccagggaaagcccctaaactcctgatctac

SEQ ID NO: 9863 - DNA, 51 bp, Artificial Sequence
  Synthetic construct
ttggcctggtatcagcacaaaccagggaaagcccccaagctcctgatctat

SEQ ID NO: 9864 - DNA, 51 bp, Artificial Sequence
  Synthetic construct
ttgagctggtttcaccagaggccaggccaatctccaaggcgcctgatttat

SEQ ID NO: 9865 - DNA, 51 bp, Artificial Sequence
  Synthetic construct
ttagcctggtaccaacttaaacctggccaggctcccaggctcctcatctct

SEQ ID NO: 9866 - DNA, 51 bp, Artificial Sequence
  Synthetic construct
atctcctggtatcagcaatacccaggggaagcccccgaactcattattttt

SEQ ID NO: 9867 - DNA, 51 bp, Artificial Sequence
  Synthetic construct
ttggcttggtaccagcaaaagccgggacagccccctaagttgctcatttac

SEQ ID NO: 9868 - DNA, 51 bp, Artificial Sequence
  Synthetic construct
ttggcctggtatcagcagaaaccagggaaagcccctaaactcctaatctat

SEQ ID NO: 9869 - DNA, 51 bp, Artificial Sequence
  Synthetic construct
ttcgcctggtaccagcagaagcctggccaggctcccaccctcctcatctct

SEQ ID NO: 9870 - DNA, 51 bp, Artificial Sequence
  Synthetic construct
ttggcctggtatcagcagaaacctggccaggctcccagtctcctcatctat

SEQ ID NO: 9871 - DNA, 51 bp, Artificial Sequence
  Synthetic construct
ttagcctggtatcagcagaaaccagggaaagcccctaagctcctgctctat

SEQ ID NO: 9872 - DNA, 51 bp, Artificial Sequence
  Synthetic construct
ttaaattggtatcagcaaaaaccagggaaagcccctaagctcctgatctat

SEQ ID NO: 9873 - DNA, 51 bp, Artificial Sequence
  Synthetic construct
gcttattggtaccagcagaagtcaggccaggcccctgtgctggtcatccat

SEQ ID NO: 9874 - DNA, 51 bp, Artificial Sequence
  Synthetic construct
ttaaactggtatcaacataaaccagggaaagccccaaaactcctgatcttc

SEQ ID NO: 9875 - DNA, 51 bp, Artificial Sequence
  Synthetic construct
ttagcctggtttcagcagaaaccagggaaagcccctaagtccctgatctat

SEQ ID NO: 9876 - DNA, 51 bp, Artificial Sequence
  Synthetic construct
ttagcctggtaccagcagagacctggccaggctcccaggctcctcatctct

SEQ ID NO: 9877 - DNA, 51 bp, Artificial Sequence
  Synthetic construct
ttagcctggtacaagcagatgcctggccaggctcccaggctcctcatctat

SEQ ID NO: 9878 - DNA, 51 bp, Artificial Sequence
  Synthetic construct
ttacactggtaccagcagaaaccaaatcagtctccaaaggtcctcatcaaa

SEQ ID NO: 9879 - DNA, 51 bp, Artificial Sequence
  Synthetic construct
ttagcctggtatcaacagaaaccagggaaagcccctaagctcctgatctat

SEQ ID NO: 9880 - DNA, 51 bp, Artificial Sequence
  Synthetic construct
ttaaattggtatcaacagagacctgggaaagcccctcagctcctgatctat

SEQ ID NO: 9881 - DNA, 51 bp, Artificial Sequence
  Synthetic construct
ttagcttggtatcagcgcaaaccaggacagcctcctaagttgctcatttac

SEQ ID NO: 9882 - DNA, 51 bp, Artificial Sequence
  Synthetic construct
ttagcctggtttcagcagaaaccagggaaagtccctaagcgcctgatctat

SEQ ID NO: 9883 - DNA, 51 bp, Artificial Sequence
  Synthetic construct
gtctcctggtaccaacaaaagccaggcaaagcccccaaactcatgatttat

SEQ ID NO: 9884 - DNA, 51 bp, Artificial Sequence
  Synthetic construct
gtctcctggtaccaaaaccacccaggcaaagcccccaaactcttgatttat

SEQ ID NO: 9885 - DNA, 51 bp, Artificial Sequence
  Synthetic construct
atttcatggtatcaacagaagccaggccagtcccctctattggtcatctat

SEQ ID NO: 9886 - DNA, 51 bp, Artificial Sequence
  Synthetic construct
gcaaactggtaccagcagaagccaggacaggcccctaaacttatcctctat

SEQ ID NO: 9887 - DNA, 51 bp, Artificial Sequence
  Synthetic construct
ttaaattggtatcagcagaaaccagggaaagcccctaagctcctgatctac

SEQ ID NO: 9888 - DNA, 51 bp, Artificial Sequence
  Synthetic construct
ttgtattgctttctgcagaaatgcaggccagtctccacactcctgatctat

SEQ ID NO: 9889 - DNA, 51 bp, Artificial Sequence
  Synthetic construct
gtgcagtggtaccagcagcgcccgggcagtgtccccaacaatgtgatctat

SEQ ID NO: 9890 - DNA, 51 bp, Artificial Sequence
  Synthetic construct
gtctcctggtaccaacaacacccaggcaatgcccccaaagtcatgatttat

SEQ ID NO: 9891 - DNA, 15 bp, Artificial Sequence
  Synthetic construct
gtccgtgggctttat

SEQ ID NO: 9892 - DNA, 51 bp, Artificial Sequence
  Synthetic construct
gtggcctggtatcagcagaaaccagggaaagcccctaagctcctgatctat

SEQ ID NO: 9893 - DNA, 51 bp, Artificial Sequence
  Synthetic construct
ttagcctggtaccaacaaaaacctggccaggctcccaggctcctcatctat

SEQ ID NO: 9894 - DNA, 51 bp, Artificial Sequence; identical to SEQ ID NO: 1849
  Synthetic construct

SEQ ID NO: 9895 - DNA, 51 bp, Artificial Sequence
  Synthetic construct
ttagcttggtaccagcagaaaccacgacagcctcctcagctgctcatttac

SEQ ID NO: 9896 - DNA, 51 bp, Artificial Sequence
  Synthetic construct
cccagttggtaccagcagaccccaggccagcccccacgctcgctcatctac

SEQ ID NO: 9897 - DNA, 51 bp, Artificial Sequence
  Synthetic construct
ttcacttggtttcaacagaggccaggccaatctccaaggcgcctaatttat

SEQ ID NO: 9898 - DNA, 51 bp, Artificial Sequence
  Synthetic construct
cccatctggtaccagcagaccccaggccaggctccacgcacgctcatctac

SEQ ID NO: 9899 - DNA, 51 bp, Artificial Sequence
  Synthetic construct
gctcggtggttccagcagaagccaggccaggcccctgtgctggtgatttat

SEQ ID NO: 9900 - DNA, 51 bp, Artificial Sequence; identical to SEQ ID NO: 1847
  Synthetic construct

SEQ ID NO: 9901 - DNA, 51 bp, Artificial Sequence
  Synthetic construct
ttagattggtatcagcagaaaccagggaaagcccctaaactcctgatttat

SEQ ID NO: 9902 - DNA, 51 bp, Artificial Sequence
  Synthetic construct
ttagtctggtaccaacagaaacctggccaggctcccaggctcctcacctat

SEQ ID NO: 9903 - DNA, 51 bp, Artificial Sequence
  Synthetic construct
ttaaattggtttcaccagaggccaggccaatctccaaggcgcctcatttat

SEQ ID NO: 9904 - DNA, 51 bp, Artificial Sequence
  Synthetic construct
gtgcactggtaccagaagaagtcaggccaggcccctgtgctcgtcgtctat

SEQ ID NO: 9905 - DNA, 51 bp, Artificial Sequence
  Synthetic construct
gtgcagtggtaccaacagcgcccgggcagcgcccccgtctctgtgatctat

SEQ ID NO: 9906 - DNA, 51 bp, Artificial Sequence
  Synthetic construct
ctggcctggtatcagcagaagccagggaaagcccctaagctcctgatctat

SEQ ID NO: 9907 - DNA, 51 bp, Artificial Sequence
  Synthetic construct
ttggcctggtaccagcacaaacgtggccaggctccccggctcctcatctat

SEQ ID NO: 9908 - DNA, 51 bp, Artificial Sequence
  Synthetic construct
ttagcttggtaccagcataaaccaggacagtctcctaaactgctcatttac

SEQ ID NO: 9909 - DNA, 51 bp, Artificial Sequence
  Synthetic construct
gtgcactggtaccagcagaagtcaggccaggcccctgtgttggtcgtctat

SEQ ID NO: 9910 - DNA, 51 bp, Artificial Sequence
  Synthetic construct
ttaaattggtatcagcagaaacctgggaaagcccctaacctcctgatctat

SEQ ID NO: 9911 - DNA, 51 bp, Artificial Sequence
  Synthetic construct
gtgcagtggtaccagcaacgcccgggcagtgcccccacaactgtgctctat

SEQ ID NO: 9912 - DNA, 51 bp, Artificial Sequence
  Synthetic construct
ataaggtggtaccaacaaaagccagggaaccctccccggtatctcctgtac

SEQ ID NO: 9913 - DNA, 51 bp, Artificial Sequence
  Synthetic construct
gtaaactggtaccagcaactcccaggaacggcccccaaattcctcatctat

SEQ ID NO: 9914 - DNA, 51 bp, Artificial Sequence
  Synthetic construct
ttagcctggtatcagcaaaaaccaggaaaagcccctaaactcctcatccat

SEQ ID NO: 9915 - DNA, 51 bp, Artificial Sequence
  Synthetic construct
gtatcctggtaccagcagctcccaggaacagcccccaaactcctcatttat

SEQ ID NO: 9916 - DNA, 51 bp, Artificial Sequence
  Synthetic construct
ttagcctggtatcagcataaaccggggacagcccctaaactcctgatctat

SEQ ID NO: 9917 - DNA, 51 bp, Artificial Sequence
  Synthetic construct
ttagcttggtatcagcagaaaccaggacagcctcctaagctgctcattttc

SEQ ID NO: 9918 - DNA, 51 bp, Artificial Sequence
  Synthetic construct
gtgcagtggtaccagcagcgcccgggcagcgcccccaccattttgatctat

SEQ ID NO: 9919 - DNA, 51 bp, Artificial Sequence
  Synthetic construct
gtgcattggtatttgcagaagccaggccgggcccctgttttggtcgtcttt

SEQ ID NO: 9920 - DNA, 51 bp, Artificial Sequence
  Synthetic construct
gtctcctggtatcaacatcacccaggcagagcccccaaactcatgatttat

SEQ ID NO: 9921 - DNA, 51 bp, Artificial Sequence
  Synthetic construct
gcaagctggtaccagcagaggccaggacaggcccctgttcttgtcatctat

SEQ ID NO: 9922 - DNA, 51 bp, Artificial Sequence
  Synthetic construct
ttggcctggtatcagcagaagcccgggaaagcccctaaactcctgatctat

SEQ ID NO: 9923 - DNA, 51 bp, Artificial Sequence
  Synthetic construct
ttggcctggtatcagcagaaaccagggaaagcccctaagctcctgatctct

SEQ ID NO: 9924 - DNA, 51 bp, Artificial Sequence
  Synthetic construct
ttgagttggtttcatcagaggccaggccaatctccgaggcgcctaatttat

SEQ ID NO: 9925 - DNA, 51 bp, Artificial Sequence
  Synthetic construct
ttggcctggtatcagcagaaaccagggaaagtccctaagctcctgatctat

SEQ ID NO: 9926 - DNA, 51 bp, Artificial Sequence
  Synthetic construct
ttaggctggtttcagcacaaaccaggcaaagcccctcagcgcctcatctat

SEQ ID NO: 9927 - DNA, 51 bp, Artificial Sequence
  Synthetic construct
gcttattggtaccagcagaagccaggccaggcccctgtgttggtgatatat

SEQ ID NO: 9928 - DNA, 51 bp, Artificial Sequence
  Synthetic construct
gtcaactggtaccagcagcttccaggaacagtccccaaactcctcatttat

SEQ ID NO: 9929 - DNA, 51 bp, Artificial Sequence
  Synthetic construct
ttagcctggtaccaacagaaacctggccagggtcccaggctcctcatctat

SEQ ID NO: 9930 - DNA, 51 bp, Artificial Sequence
  Synthetic construct
ttaaattggtatcaggtgacaccaggtaaagcccctaagctcctgatctac

SEQ ID NO: 9931 - DNA, 51 bp, Artificial Sequence
  Synthetic construct
gtctcctggtaccaacagcacccaggcaaagcccccaaactcttcatttat

SEQ ID NO: 9932 - DNA, 51 bp, Artificial Sequence
  Synthetic construct
ttagcctggtttcagcagaaaccaggggaagcccctaagtccctgctctat

SEQ ID NO: 9933 - DNA, 51 bp, Artificial Sequence
  Synthetic construct
ttgagttggcttcaggagaggccaggccagcctccaagactcctaatttat

SEQ ID NO: 9934 - DNA, 51 bp, Artificial Sequence
  Synthetic construct
ttagcctggtaccagcataaacctggccaggctcccaggctcctcatctat

SEQ ID NO: 9935 - DNA, 51 bp, Artificial Sequence
  Synthetic construct
gtctcctggtaccaacaaaacccaggcaaagtccccaaactcatgatttct

SEQ ID NO: 9936 - DNA, 51 bp, Artificial Sequence
  Synthetic construct
ttggattggtacatgcagaggccagggcagtctccacagctcctgatctat

SEQ ID NO: 9937 - DNA, 51 bp, Artificial Sequence
  Synthetic construct
ttcgcctggtaccaacagaaacctggccagcctcccaggctcctcatgtct

SEQ ID NO: 9938 - DNA, 51 bp, Artificial Sequence
  Synthetic construct
gtctcctggtaccaacaaaacccaggcaaagcccccaaactcttgatttat

SEQ ID NO: 9939 - DNA, 51 bp, Artificial Sequence
  Synthetic construct
gtctcctggtaccaacaacacccaggcaaagcccccaaactcaggatttat

SEQ ID NO: 9940 - DNA, 51 bp, Artificial Sequence
  Synthetic construct
ttagcctggtatcagcagaaaccagggaaagcccctaagctcctgatctat

SEQ ID NO: 9941 - DNA, 51 bp, Artificial Sequence
  Synthetic construct
gtgcactggtaccagcagaagccaggccaggcccctatcctggtcgtctat

SEQ ID NO: 9942 - DNA, 51 bp, Artificial Sequence
  Synthetic construct
ttagcctggtatcaacaaaagccagggaaagcccctaagctcctgatatat

SEQ ID NO: 9943 - DNA, 51 bp, Artificial Sequence
  Synthetic construct
ttagcctggtaccagcacaaacctggccaggttcccaggctcatcttcttt

SEQ ID NO: 9944 - DNA, 51 bp, Artificial Sequence
  Synthetic construct
gtgcagtggtaccagcagcgcccgggcagtgcccccacgactgtgatctat

SEQ ID NO: 9945 - DNA, 51 bp, Artificial Sequence
  Synthetic construct
ttagcctggtatcagcagaaaccagggaaggcccctaaactcctcgtctat

SEQ ID NO: 9946 - DNA, 51 bp, Artificial Sequence
  Synthetic construct
gtatcctggtaccaacaattcccaggcacagcccccaaactcctcatttat

SEQ ID NO: 9947 - DNA, 49 bp, Artificial Sequence
  Synthetic construct
acactggtaccagcacaaaccagatcagtctccaaaactgctcatcaag

SEQ ID NO: 9948 - DNA, 51 bp, Artificial Sequence
  Synthetic construct
gtagcctggtatcagcaaaaaccgggagaagtccctaagctcctgatctat

SEQ ID NO: 9949 - DNA, 51 bp, Artificial Sequence
  Synthetic construct
gttacctggtatcagcagaagccaggccagtcccctgtgttggtcatgtat

SEQ ID NO: 9950 - DNA, 51 bp, Artificial Sequence
  Synthetic construct
ttaaattggtatcagcagaaaccggggaaagcccctaggctcctgatctat

SEQ ID NO: 9951 - DNA, 51 bp, Artificial Sequence
  Synthetic construct
gtctcctggtaccaacagcacccaggcaaagcccccaaactcataattcat

SEQ ID NO: 9952 - DNA, 51 bp, Artificial Sequence
  Synthetic construct
gtctcctggtaccaaaaccacccaggcaaagcccccaaactcatgatttat

SEQ ID NO: 9953 - DNA, 51 bp, Artificial Sequence
  Synthetic construct
ttagcttggtaccagcagaaaccaggacagcctcctcagctcctcatttac

SEQ ID NO: 9954 - DNA, 51 bp, Artificial Sequence
  Synthetic construct
gtctcctggtaccaacagcacccaggcaatgcccccaaactcatgatttat

SEQ ID NO: 9955 - DNA, 51 bp, Artificial Sequence
  Synthetic construct
acttgctggtatcaacagaaggcaggccagtcccctgttctggtcatctat

SEQ ID NO: 9956 - DNA, 51 bp, Artificial Sequence
  Synthetic construct
ttaaattggtatcaacagaggccaggccaatctccaaggcgcctcgtttat

SEQ ID NO: 9957 - DNA, 51 bp, Artificial Sequence
  Synthetic construct
ttagcttggtaccagcagaaacccggacagcctcctgaactgctcatttac

SEQ ID NO: 9958 - DNA, 51 bp, Artificial Sequence
  Synthetic construct
cccagttggttccggcagaccccaggccaggctccacgcacgctcatctac

SEQ ID NO: 9959 - DNA, 51 bp, Artificial Sequence
  Synthetic construct
ttggcctggtatcagcagaaaccaggtaaagcccctaaactcctgatctct

SEQ ID NO: 9960 - DNA, 51 bp, Artificial Sequence
  Synthetic construct
ccctactggttccagcagaagcctggccaagccccccggacactgatttat

SEQ ID NO: 9961 - DNA, 51 bp, Artificial Sequence
  Synthetic construct
ttagcttggtaccagcagaaaccaggacagcctcctaaactgctcatttac

SEQ ID NO: 9962 - DNA, 51 bp, Artificial Sequence
  Synthetic construct
ttgtattggtttctgcagaaagccaggccagtctccacgctcctgatctat

SEQ ID NO: 9963 - DNA, 51 bp, Artificial Sequence
  Synthetic construct
ttagtctggtatcagcagaaaccagggaaagcccctaacctcctgatctat

SEQ ID NO: 9964 - DNA, 51 bp, Artificial Sequence
  Synthetic construct
ttagcttggtaccagcagaaaccaggacagcctccaaagctgctcatttac

SEQ ID NO: 9965 - DNA, 51 bp, Artificial Sequence
  Synthetic construct
ttggcctggtaccagcagaaacttggccaggctcccaggctcctcatctat

SEQ ID NO: 9966 - DNA, 51 bp, Artificial Sequence
  Synthetic construct
gtcacctggtaccaacagcacccaggcaaagcccccaaagtcatgatttat

SEQ ID NO: 9967 - DNA, 51 bp, Artificial Sequence
  Synthetic construct
acaagctggtaccagcagaagccaggacaggcccctgtacttgtcatctat

SEQ ID NO: 9968 - DNA, 51 bp, Artificial Sequence
  Synthetic construct
gtctcctggtaccaacaacacccaggcaaagcccccaaactcataatttat

SEQ ID NO: 9969 - DNA, 51 bp, Artificial Sequence
  Synthetic construct
ttagcctggtttcagcagaagccagggaaagcccctaagtcactaatttat

SEQ ID NO: 9970 - DNA, 51 bp, Artificial Sequence
  Synthetic construct
gtccactggtaccagcagaggccaggccaggcccctgtactggtcgtctct

SEQ ID NO: 9971 - DNA, 51 bp, Artificial Sequence
  Synthetic construct
ttagcctggtaccagcagaaacctggccaggctccccggctcctcatctat

SEQ ID NO: 9972 - DNA, 51 bp, Artificial Sequence
  Synthetic construct
ttggcctggtaccagcagaggccaggccagcctcccaggctcctcatcttt

SEQ ID NO: 9973 - DNA, 51 bp, Artificial Sequence
  Synthetic construct
gtcacctggtaccaacaactcccagggaaagcccccaaactcttaattttt

SEQ ID NO: 9974 - DNA, 51 bp, Artificial Sequence
  Synthetic construct
ttagcttggtaccagcagaaaccaggacagcctcctaagctgctgttttac

SEQ ID NO: 9975 - DNA, 51 bp, Artificial Sequence
  Synthetic construct
gtacattggtaccagcacaaggcgcgccaggccccagtactggtcgtctat

SEQ ID NO: 9976 - DNA, 51 bp, Artificial Sequence
  Synthetic construct
ttagcctggtaccagcagaaacctggccaggttcccaggctcctcttctat

SEQ ID NO: 9977 - DNA, 51 bp, Artificial Sequence
  Synthetic construct
ttagcctggtaccagcagaaacctggccaggctcccaggctcctcatatat

SEQ ID NO: 9978 - DNA, 51 bp, Artificial Sequence
  Synthetic construct
ttagcctggtaccaacagaaacctggccgggctcccaggctcctcatctat

SEQ ID NO: 9979 - DNA, 51 bp, Artificial Sequence
  Synthetic construct
ttagcctggtaccagcagagacctggccaggctcccaggctcctcatcttt

SEQ ID NO: 9980 - DNA, 51 bp, Artificial Sequence
  Synthetic construct
ttaaattggtatcagcagaaaccagggaaagcccctaagctcctgatccat

SEQ ID NO: 9981 - DNA, 51 bp, Artificial Sequence
  Synthetic construct
gtatcctggttccagcagctcccaagtagagcccccaaactcctcatctat

SEQ ID NO: 9982 - DNA, 51 bp, Artificial Sequence; identical to SEQ ID NO: 1848
  Synthetic construct

SEQ ID NO: 9983 - DNA, 51 bp, Artificial Sequence
  Synthetic construct
ttagcctggtttcagcagaaacctgggaaagcccctaagtccctgatctat

SEQ ID NO: 9984 - DNA, 51 bp, Artificial Sequence
  Synthetic construct
atagcctggtaccagcagagaccgaggcgaccgcctactcttctcatctac

SEQ ID NO: 9985 - DNA, 51 bp, Artificial Sequence
  Synthetic construct
ctggcctggtatcagcagaaaccagggaaagcccctaagctcctgatctat

SEQ ID NO: 9986 - DNA, 51 bp, Artificial Sequence
  Synthetic construct
gttttctggtatcagcagaagccaggccagtcccctgtcctggtcatctat

SEQ ID NO: 9987 - DNA, 51 bp, Artificial Sequence
  Synthetic construct
ttagcctggtatcaacagaaacctggacaggcgcccaggctcctcatttat

SEQ ID NO: 9988 - DNA, 51 bp, Artificial Sequence
  Synthetic construct
ttagcctggtaccaacagaaacctggccaggctcccaggctcctcatcttt

SEQ ID NO: 9989 - DNA, 51 bp, Artificial Sequence
  Synthetic construct
ttcaattggttccttcagaggccaggccaacctccaaggcgtcttttttat

SEQ ID NO: 9990 - DNA, 51 bp, Artificial Sequence
  Synthetic construct
ttaaattggtatcttcagaaaccagggaaagcccctaacctcttaatctat

SEQ ID NO: 9991 - DNA, 51 bp, Artificial Sequence
  Synthetic construct
gttttctggtaccagctcctcccaggaacggcccccagactcctcatgtct

SEQ ID NO: 9992 - DNA, 51 bp, Artificial Sequence
  Synthetic construct
gcagcttggctgcagcagcaccagggccaccctcccaagctcctatcctac

SEQ ID NO: 9993 - DNA, 51 bp, Artificial Sequence
  Synthetic construct
ttggcctggtatcagcagaaaccagggaaagcccctaagctcatgctccat

SEQ ID NO: 9994 - DNA, 51 bp, Artificial Sequence
  Synthetic construct
gtctcctggtaccaacaacagccaggcaaagcccccaaactcctgattttt

SEQ ID NO: 9995 - DNA, 51 bp, Artificial Sequence
  Synthetic construct
ttagcctggtaccatcagaaacctggccaggcgcccaggctcctcatatat

SEQ ID NO: 9996 - DNA, 51 bp, Artificial Sequence
  Synthetic construct
gtggattggttcctgcagaagccagggcagtctccacagctcgtcatccac

SEQ ID NO: 9997 - DNA, 51 bp, Artificial Sequence
  Synthetic construct
ttagcctggtatcagcagaaaccagggaaacccccaaaactcctgatctct

SEQ ID NO: 9998 - DNA, 51 bp, Artificial Sequence; identical to SEQ ID NO: 1851
  Synthetic construct

SEQ ID NO: 9999 - DNA, 51 bp, Artificial Sequence
  Synthetic construct
ttaggctggtatcagcagaagccagggaaagcccctaagcgcctgatctat

SEQ ID NO: 10000 - DNA, 51 bp, Artificial Sequence
  Synthetic construct
atagcctggtatcaacaaaaaccaggacaaggccctaacctcctaatacac

SEQ ID NO: 10001 - DNA, 51 bp, Artificial Sequence
  Synthetic construct
ttagcttggtaccagcagaaaccagggcagcctcctaagatgctcttttac

SEQ ID NO: 10002 - DNA, 51 bp, Artificial Sequence
  Synthetic construct
gtctcctggtaccaacagcgcccaggcgaagcccccaaactcttgatttat

SEQ ID NO: 10003 - DNA, 51 bp, Artificial Sequence
  Synthetic construct
ttagcctggtaccagcagaagccaggacagcctcctaggttgctcatttac

SEQ ID NO: 10004 - DNA, 51 bp, Artificial Sequence
  Synthetic construct
ttggcctggtttcagcagaaaccagggaaagcccctaggctcctgatctat

SEQ ID NO: 10005 - DNA, 51 bp, Artificial Sequence
  Synthetic construct
gtggcctggtatcagcagagaccagggaaagcccctaaggtcctgatctct

SEQ ID NO: 10006 - DNA, 51 bp, Artificial Sequence
  Synthetic construct
ttaaattggtatcagcagaaacctgggaaagcccctaagttcctgatctat

SEQ ID NO: 10007 - DNA, 51 bp, Artificial Sequence
  Synthetic construct
gtgcactggtaccagcagaagccaggccaggcccctgtgttggtcgtctat

SEQ ID NO: 10008 - DNA, 51 bp, Artificial Sequence
  Synthetic construct
gtgtcctggtatcagcaactccctggaacagcccccacactcctcatttat

SEQ ID NO: 10009 - DNA, 51 bp, Artificial Sequence
  Synthetic construct
ttatcttggttccagcagaaacctggtcaggctcccaggctcctcgtctat

SEQ ID NO: 10010 - DNA, 32 bp, Artificial Sequence
  Synthetic construct
acccaggcaaagcccccaaactcatgatttat

SEQ ID NO: 10011 - DNA, 51 bp, Artificial Sequence
  Synthetic construct
gtctcctggtaccaacaccacccaggcagggcccccaaattcattatgtat

SEQ ID NO: 10012 - DNA, 51 bp, Artificial Sequence
  Synthetic construct
atagcctggtatcagcagaaagctggccagagtcccaggctcctcatctct

SEQ ID NO: 10013 - DNA, 51 bp, Artificial Sequence
  Synthetic construct
ttggcctggtatcagcagaaaccagggacagcccctaaactcctggtctct

SEQ ID NO: 10014 - DNA, 51 bp, Artificial Sequence
  Synthetic construct
ttaaattggtttcagcagaaaccggggagcgcccctaaactcctcatctat

SEQ ID NO: 10015 - DNA, 51 bp, Artificial Sequence
  Synthetic construct
ttagcctggtaccaacagaagcctggccaggctcccaggctcctcatctat

SEQ ID NO: 10016 - DNA, 51 bp, Artificial Sequence
  Synthetic construct
gttcactggtaccagttgaggccaggccaggcccctgtgttggtcatccat

SEQ ID NO: 10017 - DNA, 51 bp, Artificial Sequence
  Synthetic construct
gtgtcctggtaccagcatgtcccaggagcagcccccaaactcctcatttat

SEQ ID NO: 10018 - DNA, 51 bp, Artificial Sequence
  Synthetic construct
gtttcctggcaccagcagttcccaggaacagcccccaaaatcctcatttat

SEQ ID NO: 10019 - DNA, 51 bp, Artificial Sequence
  Synthetic construct
ttagcttggtaccaacagaagccaggacagcccccaaagttgctcatttac

SEQ ID NO: 10020 - DNA, 51 bp, Artificial Sequence
  Synthetic construct
gttaactggtaccagcacctcccaggagcgccccccaaactcctcatctat

SEQ ID NO: 10021 - DNA, 51 bp, Artificial Sequence
  Synthetic construct
gtctcctggtaccaacagcgcccagggaaagccccccaactcatcatttat

SEQ ID NO: 10022 - DNA, 51 bp, Artificial Sequence
  Synthetic construct
ttagcctggtaccagcagaagcctggccaggctcccaggctcctcatctac

SEQ ID NO: 10023 - DNA, 51 bp, Artificial Sequence
  Synthetic construct
gtgaactggtaccagcagaagccaggccaggcccctgcgctggtcgtctat

SEQ ID NO: 10024 - DNA, 51 bp, Artificial Sequence
  Synthetic construct
ttggcttggtaccagcacaaaccggggcagcctcctaaactgctcctttac

SEQ ID NO: 10025 - DNA, 51 bp, Artificial Sequence
  Synthetic construct
ttgaattggtatcagcagaaaccagggaaagcccctaaactcctgatctat

SEQ ID NO: 10026 - DNA, 51 bp, Artificial Sequence
  Synthetic construct
ttagcctggtatcagcagaaaccagggaaagcccctaaactcctgatctat

SEQ ID NO: 10027 - DNA, 51 bp, Artificial Sequence
  Synthetic construct
gtatcctggtaccagcagctcccaggaacagcccccaaactcctcattttt

SEQ ID NO: 10028 - DNA, 51 bp, Artificial Sequence
  Synthetic construct
gtctcttggtaccaacaacacccaggcaaagcccccaaactcataatttac

SEQ ID NO: 10029 - DNA, 51 bp, Artificial Sequence
  Synthetic construct
ttagcctggtatcggcagagaccaggggaagcccccaaactcctgatttat

SEQ ID NO: 10030 - DNA, 51 bp, Artificial Sequence
  Synthetic construct
gtatactggtatcagcagctcccaggaacggcccccaaactcctcgtctat

SEQ ID NO: 10031 - DNA, 51 bp, Artificial Sequence
  Synthetic construct
ttatattggtacgtgcagaagccaggccagtcaccacagctcctgatctac

SEQ ID NO: 10032 - DNA, 51 bp, Artificial Sequence
  Synthetic construct
gtatcctggtaccagcagatcccaggaacagcccccaaactcctcatctat

SEQ ID NO: 10033 - DNA, 51 bp, Artificial Sequence
  Synthetic construct
ataaactggtaccagcagctcccaggaacggcccccaaactcctcatctat

SEQ ID NO: 10034 - DNA, 51 bp, Artificial Sequence
  Synthetic construct
gtgaactggtacctacagaaaccaggagaagctactcttttcattactcaa

SEQ ID NO: 10035 - DNA, 51 bp, Artificial Sequence
  Synthetic construct
ttaaattggtttcagcagaaaccagggaaagcccctaagctcctgatctat

SEQ ID NO: 10036 - DNA, 51 bp, Artificial Sequence
  Synthetic construct
ttagcctggtatcagcagaaaccagggaacgcccctaaactcctggtctct

SEQ ID NO: 10037 - DNA, 51 bp, Artificial Sequence
  Synthetic construct
ttaacctggcttcagcagagaccagggcaagcccctaagcgcctcatcttt

SEQ ID NO: 10038 - DNA, 51 bp, Artificial Sequence
  Synthetic construct
actcattggtaccagcagaagccaggccaggcccctgtgttggtaatatgt

SEQ ID NO: 10039 - DNA, 51 bp, Artificial Sequence
  Synthetic construct
ttaaattggtatcaagtgaagcctgggaaaggccctaaattcctgatgtcc

SEQ ID NO: 10040 - DNA, 51 bp, Artificial Sequence
  Synthetic construct
ctagcctggtatcagcagaaaccagggaaagcccctaaactcctgatcgct

SEQ ID NO: 10041 - DNA, 51 bp, Artificial Sequence
  Synthetic construct
ctagcttggtaccaacagaaagcaggacagcctcctaagctgctcttcttc

SEQ ID NO: 10042 - DNA, 51 bp, Artificial Sequence
  Synthetic construct
gtctcctggtttcaacaacacccaggcagagcccccaaactcatgatttat

SEQ ID NO: 10043 - DNA, 51 bp, Artificial Sequence
  Synthetic construct
ttagcctggtaccagcagaaacctggccaggctcccaggctcctcttctat

SEQ ID NO: 10044 - DNA, 51 bp, Artificial Sequence
  Synthetic construct
ttaaattggtatcagcagaaaccagggaaagcccctcagctcctgatctat

SEQ ID NO: 10045 - DNA, 51 bp, Artificial Sequence
  Synthetic construct
ttagcctggtaccaacagagacctggccaggctcccaggctcctcatctat

SEQ ID NO: 10046 - DNA, 51 bp, Artificial Sequence
  Synthetic construct
gtacattggtaccagcaccttccagggacagcccccaaactcctcatctat

SEQ ID NO: 10047 - DNA, 51 bp, Artificial Sequence
  Synthetic construct
gccaattggtaccagcagaagtcaggacaggccccgaaacttgtcatttat

SEQ ID NO: 10048 - DNA, 51 bp, Artificial Sequence
  Synthetic construct
ttagcctggtaccaacagaaacctggccagtctcccaggctcctcatctat

SEQ ID NO: 10049 - DNA, 51 bp, Artificial Sequence
  Synthetic construct
ttgacttggcttcagcagaggccaggccagcctccaagactcctcatttat

SEQ ID NO: 10050 - DNA, 51 bp, Artificial Sequence
  Synthetic construct
ttagcctggtatcaacagaagccagggaaagcccctaaactcctgatatat

SEQ ID NO: 10051 - DNA, 51 bp, Artificial Sequence
  Synthetic construct
ttacactggtaccagcaaaaatcaaatcagtctccacagctcctcatcaag

SEQ ID NO: 10052 - DNA, 51 bp, Artificial Sequence
  Synthetic construct
ttaaattggtatcaaaagaagccagggacagcccctaagctcctgatctat

SEQ ID NO: 10053 - DNA, 51 bp, Artificial Sequence
  Synthetic construct
ttagcctggtaccagcagaaacctggccaggctcccagactcctcatctat

SEQ ID NO: 10054 - DNA, 51 bp, Artificial Sequence
  Synthetic construct
ttagcctggtatcaacagagaccagggaaagcccctaaactcctcctctat

SEQ ID NO: 10055 - DNA, 51 bp, Artificial Sequence
  Synthetic construct
gtctcctggtaccaacaaaacccaggcaaagcccccaaagtcttgatttat

SEQ ID NO: 10056 - DNA, 51 bp, Artificial Sequence
  Synthetic construct
atattttggtatcagcagaagccagggagccctcccaggtatctcctatat

SEQ ID NO: 10057 - DNA, 51 bp, Artificial Sequence
  Synthetic construct
ttaaattggtatcagtggaaaccagggaaagcccctaaggtcctgatttac

SEQ ID NO: 10058 - DNA, 29 bp, Artificial Sequence
  Synthetic construct
caggcaaagcccccaaagtcttgatttat

SEQ ID NO: 10059 - DNA, 51 bp, Artificial Sequence
  Synthetic construct
ttagcctggtatcagcagaaagcagggaaggccccaaagctcctgatctat

SEQ ID NO: 10060 - DNA, 51 bp, Artificial Sequence
  Synthetic construct
ttagcctggtaccagtacaaatctggccaggctcccaaactcctcatcttt

SEQ ID NO: 10061 - DNA, 51 bp, Artificial Sequence
  Synthetic construct
gtctcctggtatcagcagttcccaggagcagcccccgaactcctccttttt

SEQ ID NO: 10062 - DNA, 51 bp, Artificial Sequence
  Synthetic construct
gtgcagtggtaccagcagaagccaggccaggcccctgtgctggtcgtctat

SEQ ID NO: 10063 - DNA, 51 bp, Artificial Sequence
  Synthetic construct
ttaggttggtaccagcagaaaccaggacagcctcctaagttgctcctttac

SEQ ID NO: 10064 - DNA, 51 bp, Artificial Sequence
  Synthetic construct
gtaaattggtaccagcagctcccaggaacggcccccaaactcctcatttat

SEQ ID NO: 10065 - DNA, 51 bp, Artificial Sequence
  Synthetic construct
atacactggtaccaggaccttccaggaacagcccccaaactcctcatctat

SEQ ID NO: 10066 - DNA, 51 bp, Artificial Sequence
  Synthetic construct
gttaattggtaccagcatcgctcaggatcggcccccaaagtcctcatctat

SEQ ID NO: 10067 - DNA, 51 bp, Artificial Sequence
  Synthetic construct
gtgtattggtatcgacagaagtcaggccaggcccctttactggtcgtctct

SEQ ID NO: 10068 - DNA, 51 bp, Artificial Sequence
  Synthetic construct
gtttcctggtaccagcacttcccaggaacagcccccaaactcttcatttat

SEQ ID NO: 10069 - DNA, 51 bp, Artificial Sequence
  Synthetic construct
ttagcctggtatcagcagaaaccagggaaagcccctaagctcctactctat

SEQ ID NO: 10070 - DNA, 51 bp, Artificial Sequence
  Synthetic construct
ttggactggtatctgcagaggccagggcagtctccacaactcctgatctat

SEQ ID NO: 10071 - DNA, 51 bp, Artificial Sequence
  Synthetic construct
ttaaattggtatcagcagagacctgggaaggcccctaaactcctgatcttt

SEQ ID NO: 10072 - DNA, 51 bp, Artificial Sequence
  Synthetic construct
gtctcctggtatcaacaatacccaggcaaagcccccaaactcatgatttat

SEQ ID NO: 10073 - DNA, 51 bp, Artificial Sequence
  Synthetic construct
ttggattggtatttgcagaagccagggcagtctccacagctcctgatctat

SEQ ID NO: 10074 - DNA, 51 bp, Artificial Sequence
  Synthetic construct
gtatcctggtaccagcagctcccaggaacagcccccaaactcctcatctat

SEQ ID NO: 10075 - DNA, 51 bp, Artificial Sequence
  Synthetic construct
ttaaattggtatcagcacaaacctgggaaagcccctaaactcctgatctac

SEQ ID NO: 10076 - DNA, 51 bp, Artificial Sequence
  Synthetic construct
ttagcctggtatcagcaaaaaccagggaaagcccctaagctcctgatctct

SEQ ID NO: 10077 - DNA, 51 bp, Artificial Sequence
  Synthetic construct
ttagcctggtatcagcagaaaccagggaaagcccctaggctcctgatccat

SEQ ID NO: 10078 - DNA, 51 bp, Artificial Sequence
  Synthetic construct
ttagcctggtttcagcagagaccagggaaagtccctaagcgcctgatctat

SEQ ID NO: 10079 - DNA, 51 bp, Artificial Sequence
  Synthetic construct
ttagcttggtaccagcagaaaccaggacagcctcctaagctcctcatttac

SEQ ID NO: 10080 - DNA, 51 bp, Artificial Sequence
  Synthetic construct
ttagtctggtaccagcagaaacctggccaggctcccaggctcctcatctat

SEQ ID NO: 10081 - DNA, 51 bp, Artificial Sequence
  Synthetic construct
atcgcatggcatcagcagcagccagagaagggccctcgatatttgatgaag

SEQ ID NO: 10082 - DNA, 51 bp, Artificial Sequence
  Synthetic construct
attcactggtaccaacagattcaaggagcagcccccaaactcctcatctat

SEQ ID NO: 10083 - DNA, 51 bp, Artificial Sequence
  Synthetic construct
ttagcctggtaccagcagaaacctggccaggctcccaggctcctcatcttt

SEQ ID NO: 10084 - DNA, 51 bp, Artificial Sequence
  Synthetic construct
tttgcctggtaccaacagaaacctggccaggctccccgactcctcatctat

SEQ ID NO: 10085 - DNA, 51 bp, Artificial Sequence
  Synthetic construct
ttagcctggtatcagcagaaaccagggaaagttcctaagctcctaatctat

SEQ ID NO: 10086 - DNA, 51 bp, Artificial Sequence
  Synthetic construct
ccaaactggttccagcagaaacctggacaagcacccagggcactgatttat

SEQ ID NO: 10087 - DNA, 51 bp, Artificial Sequence
  Synthetic construct
ttggcctggtatcagcagaagccagggaaagcccctaaactcctgatcttt

SEQ ID NO: 10088 - DNA, 51 bp, Artificial Sequence
  Synthetic construct
ggatgctggtaccagcagaaggcaggacaggcccctgtacttgtcatctat

SEQ ID NO: 10089 - DNA, 51 bp, Artificial Sequence
  Synthetic construct
ttaaattggtatcaacaaaagccagggaaagcccctcacctcctgatctac

SEQ ID NO: 10090 - DNA, 51 bp, Artificial Sequence
  Synthetic construct
ttaaattggtatcagcaaaaaccagggaaagcccctaatttcctgatcttt

SEQ ID NO: 10091 - DNA, 51 bp, Artificial Sequence
  Synthetic construct
ttggactggtacctgcagaagccagggcagtctccacagctcctaatctat

SEQ ID NO: 10092 - DNA, 51 bp, Artificial Sequence
  Synthetic construct
ttagcttggtaccagcagaaaccaggacagcctcctgaggtgctcatttac

SEQ ID NO: 10093 - DNA, 12 bp, Artificial Sequence
  Synthetic construct
ctgctcgtctat

SEQ ID NO: 10094 - DNA, 51 bp, Artificial Sequence
  Synthetic construct
ttaaattggtatcagcacaagtcagggacagcccctaaactactaatctct

SEQ ID NO: 10095 - DNA, 51 bp, Artificial Sequence
  Synthetic construct
ttaaattggtatcagcagagaccagggaaagcccctaacctcctgatctat

SEQ ID NO: 10096 - DNA, 51 bp, Artificial Sequence
  Synthetic construct
gtctcctggtaccaacagcacccaggcagaacccccaaactcataatttat

SEQ ID NO: 10097 - DNA, 51 bp, Artificial Sequence
  Synthetic construct
ttagcctggtaccaacagaaacctggccagcctcccaggctcctcatctat

SEQ ID NO: 10098 - DNA, 51 bp, Artificial Sequence
  Synthetic construct
acttcttggtatcaacagaagccaggccagtcccctgtattggtcatctat

SEQ ID NO: 10099 - DNA, 51 bp, Artificial Sequence
  Synthetic construct
ttagcttggtatcagcagaaaccagggcagcctcctaaactcctcctttac

SEQ ID NO: 10100 - DNA, 51 bp, Artificial Sequence
  Synthetic construct
gtgaagtggtaccagcaggtcccaggaacggcgcccaaactcctcatttat

SEQ ID NO: 10101 - DNA, 51 bp, Artificial Sequence
  Synthetic construct
gtttcgtggtaccaacacctcccaggaacagcccccaaactcgtcatctat

SEQ ID NO: 10102 - DNA, 51 bp, Artificial Sequence
  Synthetic construct
ctagcctggtatcaacaaggaccagggaaagcccctaagctcctgatctat

SEQ ID NO: 10103 - DNA, 51 bp, Artificial Sequence
  Synthetic construct
ttaaattggtatcagcaaaaaccagggaaagcccctcagctcctgatctat

SEQ ID NO: 10104 - DNA, 51 bp, Artificial Sequence
  Synthetic construct
gtacactggtatcagaaacttccaggagtagcccccaaactcctcatctat

SEQ ID NO: 10105 - DNA, 47 bp, Artificial Sequence
  Synthetic construct
gggggttccagcagaagccaggccaggcccctgtgttggtgatatat

SEQ ID NO: 10106 - DNA, 51 bp, Artificial Sequence
  Synthetic construct
gtggcctggtatcagcagaaaccagggaaagcccctaagctcctcatctat

SEQ ID NO: 10107 - DNA, 51 bp, Artificial Sequence
  Synthetic construct
gtaaattggtatcagcagaaaccagggaaagcccctaacctcctgatctat

SEQ ID NO: 10108 - DNA, 51 bp, Artificial Sequence
  Synthetic construct
ttagcctggtaccagcaaaaacctggccaggctcccaggctcctcatcttt

SEQ ID NO: 10109 - DNA, 51 bp, Artificial Sequence
  Synthetic construct
gttcactggtatcagcttcttccaggaacagcccccaaactcctcatctat

SEQ ID NO: 10110 - DNA, 51 bp, Artificial Sequence
  Synthetic construct
ttaaattggtatcaacagagacctgggaaggcccctaaactcctgatcttt

SEQ ID NO: 10111 - DNA, 51 bp, Artificial Sequence
  Synthetic construct
ttagcctggtaccagcaaaagggtggccaggctcccaggctcctcattcat

SEQ ID NO: 10112 - DNA, 51 bp, Artificial Sequence
  Synthetic construct
ttaaattggcttcaggagaggccaggccaatctccaaggcgccttatttat

SEQ ID NO: 10113 - DNA, 51 bp, Artificial Sequence
  Synthetic construct
gtctcctggtaccaacaacaaccagggaaagcccccagactcttgatcttt

SEQ ID NO: 10114 - DNA, 51 bp, Artificial Sequence
  Synthetic construct
gtacactggtatcagaagaggccaggccaggccccggtgctgctcgtctat

SEQ ID NO: 10115 - DNA, 51 bp, Artificial Sequence
  Synthetic construct
ctagcttggtatcagcagaaaccaggacagcgtcctaagttgctcatttat

SEQ ID NO: 10116 - DNA, 51 bp, Artificial Sequence
  Synthetic construct
gtagcctggttccagtataatgttggccggcctcccaggctcctcatctat

SEQ ID NO: 10117 - DNA, 51 bp, Artificial Sequence
  Synthetic construct
gtccactggtaccagcagaagccaggccaggcccctgtgttggtcgtctat

SEQ ID NO: 10118 - DNA, 51 bp, Artificial Sequence
  Synthetic construct
ttaggctggtatcagcagaaaccagggacagcccctaagctcctgatctat

SEQ ID NO: 10119 - DNA, 51 bp, Artificial Sequence
  Synthetic construct
ttagcctggtatcagctaaaaccagggaaagcccctaagctcctgatctat

SEQ ID NO: 10120 - DNA, 51 bp, Artificial Sequence
  Synthetic construct
ttaaattggtatcagcacaaaccagggaaagcccctaagttcctgatttat

SEQ ID NO: 10121 - DNA, 51 bp, Artificial Sequence
  Synthetic construct
ttagcctggtaccaactgaaacctggccaggctcccaggctcctcatctat

SEQ ID NO: 10122 - DNA, 51 bp, Artificial Sequence
  Synthetic construct
gtgcactggtgccagcaaacgccaggccaggaccctctgctggtcatctat

SEQ ID NO: 10123 - DNA, 31 bp, Artificial Sequence
  Synthetic construct
cccaggcaaagcccccaaactcatgatttat

SEQ ID NO: 10124 - DNA, 51 bp, Artificial Sequence
  Synthetic construct
gtgcactggtaccgacagaagccaggccaggcccctgttttggtcgtctat

SEQ ID NO: 10125 - DNA, 51 bp, Artificial Sequence
  Synthetic construct
gtctcctggtaccagcaactcccaggaacagcccccagactcctcatctat

SEQ ID NO: 10126 - DNA, 51 bp, Artificial Sequence
  Synthetic construct
ttgtattggtacctgcagaagccaggccagtctccacagctcctaatctat

SEQ ID NO: 10127 - DNA, 51 bp, Artificial Sequence
  Synthetic construct
ttagcctggtatcagcagaagcctggccaggctcccagactcctcatctat

SEQ ID NO: 10128 - DNA, 51 bp, Artificial Sequence
  Synthetic construct
gtctcctggtaccaacagcacccaggcaaagcccccaaactcatgatttct

SEQ ID NO: 10129 - DNA, 51 bp, Artificial Sequence
  Synthetic construct
gtctcctggtaccagcaacacccaggcaaagcccccaaactcatgatttat

SEQ ID NO: 10130 - DNA, 51 bp, Artificial Sequence
  Synthetic construct
gtgaactggtaccagcaactcccaggaacggcccccaaactcgtcgtctat

SEQ ID NO: 10131 - DNA, 51 bp, Artificial Sequence
  Synthetic construct
ttaaattggtatcagcagacaccagggaaagcccctaaactcctgatctac

SEQ ID NO: 10132 - DNA, 51 bp, Artificial Sequence
  Synthetic construct
agttattggtaccagcagaaggcaggccaggcccctcttctggtaatgtat

SEQ ID NO: 10133 - DNA, 51 bp, Artificial Sequence
  Synthetic construct
ttagcctggttccaacaaaaacctggccaggctcccaggctcctcatctat

SEQ ID NO: 10134 - DNA, 51 bp, Artificial Sequence
  Synthetic construct
gtctcctggtaccagcaataccctggcaaaacccccaaactcataatttat

SEQ ID NO: 10135 - DNA, 51 bp, Artificial Sequence
  Synthetic construct
ttggcctggtatcagcagaaaccagggaaagcccccaagctcctgatctat

SEQ ID NO: 10136 - DNA, 51 bp, Artificial Sequence
  Synthetic construct
ttggcctggtaccagcagaagcctggccaggctcccaggctcctcatctat

SEQ ID NO: 10137 - DNA, 51 bp, Artificial Sequence
  Synthetic construct
gctttttggtaccagcagaagacaggccaggcccctcttttattactatat

SEQ ID NO: 10138 - DNA, 51 bp, Artificial Sequence
  Synthetic construct
ttagcctggtaccagcagaaacctggccaggctcccagcctcctcatctat

SEQ ID NO: 10139 - DNA, 51 bp, Artificial Sequence
  Synthetic construct
ttagcctggtatcagcaaaaaccaggggaagcccctaaactcctgctctat

SEQ ID NO: 10140 - DNA, 51 bp, Artificial Sequence
  Synthetic construct
gtttcctggtaccagcaggtcccaggaacagcccccaaactcctcatctat

SEQ ID NO: 10141 - DNA, 51 bp, Artificial Sequence
  Synthetic construct
ttaggctggtttcagcagaaaccagggaaagcccctaagcgcctgatctat

SEQ ID NO: 10142 - DNA, 51 bp, Artificial Sequence
  Synthetic construct
gtctcctggtaccaacagcacccaggcaaagcccccaaactcttaatttat

SEQ ID NO: 10143 - DNA, 51 bp, Artificial Sequence; identical to SEQ ID NO: 1852
  Synthetic construct

SEQ ID NO: 10144 - DNA, 51 bp, Artificial Sequence
  Synthetic construct
gtgcattggtaccaactgaagccaggccaggcccctgtgctggtcgtccat

SEQ ID NO: 10145 - DNA, 51 bp, Artificial Sequence
  Synthetic construct
ttagcctggtaccagcacaaacctggccaacctccccggctcctcatttat

SEQ ID NO: 10146 - DNA, 51 bp, Artificial Sequence
  Synthetic construct
ttagcctggtatcaacagagaccagggaaagcccctaaactcctgatctat

SEQ ID NO: 10147 - DNA, 51 bp, Artificial Sequence
  Synthetic construct
ctagcctggtaccagcagaaacctggccaggctcccaggctcctcatgtat

SEQ ID NO: 10148 - DNA, 51 bp, Artificial Sequence
  Synthetic construct
gtgcactggtaccagcagaagccaggccaggccccagtgctggtcgtctat

SEQ ID NO: 10149 - DNA, 51 bp, Artificial Sequence
  Synthetic construct
gtgtcctggttccaacagaagccagacaaagcccccagactcataatttat

SEQ ID NO: 10150 - DNA, 51 bp, Artificial Sequence
  Synthetic construct
gtacactggtaccagcagcgtccaggaacagtccccaaactcctcatctat

SEQ ID NO: 10151 - DNA, 108 bp, Artificial Sequence
  Synthetic construct
agtagggccactggcaccccagacaggttcagtggcagtgggtctgggacagacttcactctcaccatcagcagactggagcctgaagattttgcagtgtattactgt

SEQ ID NO: 10152 - DNA, 108 bp, Artificial Sequence
  Synthetic construct
actttagagaatggggtcccctcacggttcagcggcagtggatttgggacagaattcactctcgccatcagcagcctgcaccctgatgattttgcaacttattactgc

SEQ ID NO: 10153 - DNA, 108 bp, Artificial Sequence
  Synthetic construct
aatcggccctcgggggtttctagtcgcttctctggctccaagtctggcaacacggcctccctgaccatctctgggctccaggctgaggacgaggctgattattactgc

SEQ ID NO: 10154 - DNA, 108 bp, Artificial Sequence
  Synthetic construct
agattgaaaagtggggtcccatcccgattcagtggcagtggatctgggacggattacagcctcaccatcgatagcctgcagcctgaagattttgcaacatatttctgt

SEQ ID NO: 10155 - DNA, 108 bp, Artificial Sequence
  Synthetic construct
agcagggccactggcgttccagataggttcagtgccagtgggtctgggacagagttcagtctcactatcagcagactggagcctgaagattttgcagtgtattactgt

SEQ ID NO: 10156 - DNA, 108 bp, Artificial Sequence
  Synthetic construct
aggagggccactggcgtcccagacaggttcagtggcagtgggtctgggacagagttcactctctccatcgccggactggagcctgaagattttggagtgtattactgt

SEQ ID NO: 10157 - DNA, 108 bp, Artificial Sequence
  Synthetic construct
aacagacactcctggacacctgcccggttctcaggctccctccttgggggcgaagctgccctgaccctttcgggtgcgcagcctgaggatgaggctgactattactgc

SEQ ID NO: 10158 - DNA, 108 bp, Artificial Sequence
  Synthetic construct
aagaggccctcaggtgtccctgatcgcttctctgcctccaggtctggcaacacggcctccctgaccatctctgggctccaggctgacgatgaggctgtctatttttgt

SEQ ID NO: 10159 - DNA, 108 bp, Artificial Sequence
  Synthetic construct
atcagggccactggcgtcccagacaggttcagtggcagtgggtctgggacagacttcactctcaccatcagcagactggagcctgaagattttgcagtgtattactgt

SEQ ID NO: 10160 - DNA, 108 bp, Artificial Sequence
  Synthetic construct
agtttagagagtggggtcccatcaaggttcagcggcagtggatctggaacagagttcactctcactatcagtagcctgcagcctgatgattttgcaacttattactgc

SEQ ID NO: 10161 - DNA, 108 bp, Artificial Sequence
  Synthetic construct
aatcggccctcaggggtttccaatcgcttctctggctccaagtctggcaacacggcctccctgaccatctctggcctccaggctgaagacgaggctgattactactgc

SEQ ID NO: 10162 - DNA, 108 bp, Artificial Sequence
  Synthetic construct
acccgggaatccggggtccccgaccgattcagtggcagcggctctgagacagatttcactctcaccatcagcggcctgcaggctgaagatgtggcagtttattactgt

SEQ ID NO: 10163 - DNA, 108 bp, Artificial Sequence
  Synthetic construct
cagaggccttcaaatatccctgagcgattctctggttccagctcagggacaatagtcacgttgaccattagtggagtccaggcagaagacgaggctgactattactgt

SEQ ID NO: 10164 - DNA, 42 bp, Artificial Sequence
  Synthetic construct
atctctgggctccaggctgacgacgaggctgattattactgc

SEQ ID NO: 10165 - DNA, 108 bp, Artificial Sequence
  Synthetic construct
cacagggccactggcatcccagccaggttcagtggcagtgggtctgggacagacttcactctcaccatcaacagcctggagcctgaagattctgcagtttattactgt

SEQ ID NO: 10166 - DNA, 108 bp, Artificial Sequence
  Synthetic construct
acccgggaatccggggtccctgaccgattcagtggcagcgggtctgggacagatttcactctcaccatcaacagcctgcagtctgaagatgtggcagtttattactgt

SEQ ID NO: 10167 - DNA, 108 bp, Artificial Sequence
  Synthetic construct
accagggccactggcatccccgacaggttcagtggcagtgggtctgggacagacttcactctcaccgtcagcagactggagcctgaagattttgcagtctattactgt

SEQ ID NO: 10168 - DNA, 108 bp, Artificial Sequence
  Synthetic construct
aatcggccctcagggatttctaatcgcttctctggctccaagtctggcaacacggcctccctgaccatctctgggctccaggctgacgacgaggctgattattactgc

SEQ ID NO: 10169 - DNA, 108 bp, Artificial Sequence
  Synthetic construct
acccgggagtccggggtccctgaccgattcagtggcagcgggtctgggacagatttcaatctcaccatcagcagcctgcaggctgaagatgtggcagtttattactgt

SEQ ID NO: 10170 - DNA, 108 bp, Artificial Sequence
  Synthetic construct
attcggccctcaggggtccctgaccgattctcaggctccaagtctggcacctcagcctccctggccatcagtgggctccaggctgaggatgaggctgattattactgc

SEQ ID NO: 10171 - DNA, 108 bp, Artificial Sequence
  Synthetic construct
aagcggccctctggggtccctgatcgcttctctggctccaagtctggcaacacggcctccctgaccgtctctgggctccaggctgaggatgaggctgattattattgc

SEQ ID NO: 10172 - DNA, 108 bp, Artificial Sequence
  Synthetic construct
gtccgggaatccggggtccctgaccgattcagtggcgccgggtctgggacagatttcaccctcactatcagcagcctgcaggctgaagatgtggcagtttattactgt

SEQ ID NO: 10173 - DNA, 108 bp, Artificial Sequence
  Synthetic construct
aagcggccctcagggatcccagaccgattctctgcctccaggtcaggagacacagcttccttgaccatcagtggggctcaggcggaagatgaggctgactattactgt

SEQ ID NO: 10174 - DNA, 114 bp, Artificial Sequence
  Synthetic construct
caaagaccctctggggtccctgctcggttctctggctccatcgacaggtcctccaactctgcctccctcatcatctctggtctgagcactgaggacgaggctgactactattgt

SEQ ID NO: 10175 - DNA, 108 bp, Artificial Sequence
  Synthetic construct
acccgggaatccggggtccctgaccgcttcagtggcagcgggtctgagacggatttcactctcaccatcagcagcctgcagcctgaggatgtggcaatttatttctgt

SEQ ID NO: 10176 - DNA, 108 bp, Artificial Sequence
  Synthetic construct
cagtccatttcaggggtcccctcgaggttcagtggcagtggatccgggacagatttcaccctcaccatcaatggcctggaacctgaagatgctgcaacgtattactgc

SEQ ID NO: 10177 - DNA, 108 bp, Artificial Sequence
  Synthetic construct
acaagggccgctggcatcgcagacaggttcagtggcagtggctctgggacagacttcactctcaccatcagcagactggagcctgaagattttgcagtgtattactgt

SEQ ID NO: 10178 - DNA, 108 bp, Artificial Sequence
  Synthetic construct
accagggccactggcatcccagacaggttcagtggcagtgggtctgggacagacttcactctcaccattaacagactggagcctgaagattctgcagtatattactgt

SEQ ID NO: 10179 - DNA, 108 bp, Artificial Sequence
  Synthetic construct
agcagggccactggcttcccagacaggttcagtggcagtgggtctgggacagacttcactctcaccatcagcagactggagcctgaagattttgcagtgtatttctgt

SEQ ID NO: 10180 - DNA, 108 bp, Artificial Sequence
  Synthetic construct
agcagggccgctggcatcccagacaggttcagtggcagtggctctgggacagacttcactctcaccatcaccagactggagcctgacgattttgcaatgtattactgt

SEQ ID NO: 10181 - DNA, 108 bp, Artificial Sequence
  Synthetic construct
gaccggccctcagggatccccgagcgattctcaggctccaactctgggaacacggccaccttgaccatcaccacggtcgaggtcggggatgaggccgactattattgt

SEQ ID NO: 10182 - DNA, 108 bp, Artificial Sequence
  Synthetic construct
cagcggccctcaggggtccctgaccgattctctggctccaagtctggcacctcagcctccctggccatcagtgggctccagtctgaggatgaggctgattattactgt

SEQ ID NO: 10183 - DNA, 108 bp, Artificial Sequence
  Synthetic construct
agtttgcaaagtggggtcccttcacggttcagtggcagtgggtctgggacagatttcactctcaccatcagcagactgcaatctgaggattttgcaacttacttctgt

SEQ ID NO: 10184 - DNA, 108 bp, Artificial Sequence
  Synthetic construct
aagcggccctcaggggtttctaatcgcttctctggctccaagtctggcaacacggcctccctgacaatctctgggctccaggctgaggacgaggctgattgtcactgc

SEQ ID NO: 10185 - DNA, 108 bp, Artificial Sequence
  Synthetic construct
agccgggtctctggagtgccagataggttcagtggcaccgggtcagggacagatttcacactgaaaatcagccgggtggaggctgaggatgttgggatttattactgc

SEQ ID NO: 10186 - DNA, 108 bp, Artificial Sequence
  Synthetic construct
actttgcaaagtggggtcccatcaaggttcagcggcagtggatctgggacagatttcactctcaccatcagcagcctgcagcctgaagattttgcaacttattattgt

SEQ ID NO: 10187 - DNA, 27 bp, Artificial Sequence
  Synthetic construct
gcagaagacgaggctgactattactgt

SEQ ID NO: 10188 - DNA, 108 bp, Artificial Sequence
  Synthetic construct
actttgcaaagtggggtcccatcaaggttcagtggcagtggatctgggacagatttcactctcaccatcagctgcctgcagtctgaagattttgcaacttattactgt

SEQ ID NO: 10189 - DNA, 108 bp, Artificial Sequence
  Synthetic construct
gtgaggccctcagggatccctgagcgattctctgcctccaagtcaggggcaacggtcacgttgaccatcaggggagtccaggcagaagacgagggtgactattattgt

SEQ ID NO: 10190 - DNA, 108 bp, Artificial Sequence
  Synthetic construct
cagcggccctcaggggtccctgaccgattctctggctccaagtctggcacctcagcctccctggccatcagtgggctccggtccgaggatgaggctgattattactgt

SEQ ID NO: 10191 - DNA, 108 bp, Artificial Sequence
  Synthetic construct
agtttagaaagtggggtcccgtcaaggttcagcggcagtggatctgggacagagttcactctcaccatcaacagcctgcagcctgatgattttgcaacttattactgc

SEQ ID NO: 10192 - DNA, 108 bp, Artificial Sequence
  Synthetic construct
gaacggccctctggggtttctaatcgcttctctggctccaagtctggcgacacggcctccctgacaatctctggtctccagactgacgacgaggcggattattattgc

SEQ ID NO: 10193 - DNA, 108 bp, Artificial Sequence
  Synthetic construct
agtttgcaaagtgaggtcccgtcaaggttcagcggcagtggatctgggacagatttcactctcaccatcaacagcctgcagcctgaagattttgcaacttactattgt

SEQ ID NO: 10194 - DNA, 108 bp, Artificial Sequence
  Synthetic construct
tccaagggggatggcatccctgatcgcttctcagtcttgggctcaggcctgaatcggtacctgaccatcaagaacatccaagaggaggatgaaggtgactatcactgt

SEQ ID NO: 10195 - DNA, 108 bp, Artificial Sequence
  Synthetic construct
actttgcagagtggggtcccatcaaggttcagcggcagtggatctgggacagaattcactctcacaatcagcagcctgcagcctgaagattttgcaacgtattactgt

SEQ ID NO: 10196 - DNA, 108 bp, Artificial Sequence
  Synthetic construct
agcagggccactggcatcccagacaggttcagtggcagtgggtctgggacagacttcattctcaccatcagcagactggagcctgaagattttgcagtgtattgctgt

SEQ ID NO: 10197 - DNA, 108 bp, Artificial Sequence
  Synthetic construct
acccgggaatccggggtccctgaccgattcagtggcagcgggtctgggacagatttcactctcaccatcagcagcctgcaggctgaagatgtggcagtttattactgt

SEQ ID NO: 10198 - DNA, 108 bp, Artificial Sequence
  Synthetic construct
aaccgggactctggggtcccagacagattcagcggcagtgggtcaggcactgatttcacactgacaatcagcagggtggaggctgaggatgttggcgtttattactgc

SEQ ID NO: 10199 - DNA, 108 bp, Artificial Sequence; identical to SEQ ID NO: 1856
  Synthetic construct

SEQ ID NO: 10200 - DNA, 108 bp, Artificial Sequence
  Synthetic construct
catcggccctcaggggtccctgatcgcttctctggctccaagtctggcaccacggcctccctgaccatctctgggctccaggctgcggacgaggctgattactattgc

SEQ ID NO: 10201 - DNA, 108 bp, Artificial Sequence
  Synthetic construct
agtcggccctcaggggtccctgaccgattctctggctccaagtctggcaacacggcctccctgaccatctctgggctccaggctgacgacgaggctgattattactgc

SEQ ID NO: 10202 - DNA, 108 bp, Artificial Sequence
  Synthetic construct
aagcggccctcaggggtttctaatcgcttctctggctccaagtctggcaacacggcctccctgacaatctctgggctccgggctgaggacgaggctgattattcctgc

SEQ ID NO: 10203 - DNA, 108 bp, Artificial Sequence
  Synthetic construct
gaccggccctcagggatccctgagcgattctctggctccaactctgggagcacggccaccctgaccatcagcagggtcgaagccggggatgaggccgactattactgt

SEQ ID NO: 10204 - DNA, 108 bp, Artificial Sequence
  Synthetic construct
agtagggccactggcatcccggccaggttcagtggcagtgggtctgggacagacttcactctcaccatcagcagcctggagcctgaagattttgcaatttattactgt

SEQ ID NO: 10205 - DNA, 108 bp, Artificial Sequence
  Synthetic construct
aaccgggactatggggtcccagacagattcagcggcagtgggtcagacactgatttcacactgagaatcagcagggtggaggctgaggatgttggactttattactgc

SEQ ID NO: 10206 - DNA, 108 bp, Artificial Sequence
  Synthetic construct
acgagggccactggtaccacagccaggttcagtggcagtgggtctgggacagagttcactctcaccatcagcagcctgcagtctgaagattttgcagtttattactgt

SEQ ID NO: 10207 - DNA, 108 bp, Artificial Sequence
  Synthetic construct
catcaggatgacgagttgtctgatcgcttctcaggctccttctctggggctgaccgctacctcaccatctccagcctccagcctgaggatgaggctgactattactgt

SEQ ID NO: 10208 - DNA, 108 bp, Artificial Sequence
  Synthetic construct
aatcggccctcaggggtccctgaccgattctctggctccaagtctggcacctcagttttcctggccatcactgggctccaggctgaggatgaggctgattattactgc

SEQ ID NO: 10209 - DNA, 108 bp, Artificial Sequence
  Synthetic construct
accagggccactggcatcccagacaggttcagtggcagtgggtctggggcagacttcactctcaccatcagcagtctgcagcctgaggattttgcagtctattactgt

SEQ ID NO: 10210 - DNA, 108 bp, Artificial Sequence
  Synthetic construct
aagagggccactggcatcccagccaggttcagtggcagtgggtctgggacagacttcactctcaccatcagcagcctagaacctgaggattttgcagtttattactgt

SEQ ID NO: 10211 - DNA, 108 bp, Artificial Sequence
  Synthetic construct
aacagggccgatggcatcccagacaggttcagtggcagtgggtctgggacagagtacactctcaccatcaccaggctggagcctgaagatgttgcggtatattattgt

SEQ ID NO: 10212 - DNA, 108 bp, Artificial Sequence
  Synthetic construct
aaccgggactctggggtcccagacagattcagcggcagtgggtcagccactgattttacactgagaatcagcagcgtggaggctgaggatgttgggatttattactgc

SEQ ID NO: 10213 - DNA, 108 bp, Artificial Sequence
  Synthetic construct
aatgggccctcagggatttctaatcgcttctctggctccaagtctggcaacacggcctccctgaccatctctgggctccaggctgacgacgaggctgattattactgc

SEQ ID NO: 10214 - DNA, 108 bp, Artificial Sequence
  Synthetic construct
aagcggccctcaggggtttctaatcgcttctctggctccaagtctggcaacacggcctccctgacaatctctgggctccaggctgaggacgaggttgattattactgc

SEQ ID NO: 10215 - DNA, 108 bp, Artificial Sequence
  Synthetic construct
acacgggaatccggggtccctgaccgattcattggcagcgggtctgggacagatttcactctcaccatcaccagcctgcaggctgaagatgtggcagtttattactgt

SEQ ID NO: 10216 - DNA, 108 bp, Artificial Sequence
  Synthetic construct
aacagggtcactggcatcccagccaggttcagtggcagtgggtctgggacagacttcactctcaccatcagcagcctagagcctgaagattttgcagtttattactgt

SEQ ID NO: 10217 - DNA, 108 bp, Artificial Sequence
  Synthetic construct
aacaaacactcctggacacctgcccggttctcaggctccctccttgggggcaaagctgccctgaccctttcgggtgcgcagcctgaggatgaggctgagtattactgc

SEQ ID NO: 10218 - DNA, 108 bp, Artificial Sequence
  Synthetic construct
agtttgcaaagtggggtcccatcaaggttcagcggcagtggatctgggacagaattcactctcacaatcagcagcctgcagcctgaagattttgcaatttattactgt

SEQ ID NO: 10219 - DNA, 108 bp, Artificial Sequence
  Synthetic construct
accagggcccctggtgtcccagccaggttcagtggcggtgggtctgggacagacttcactctcaccatcagcagcctggagtctgaagattttgcagtttattactgt

SEQ ID NO: 10220 - DNA, 108 bp, Artificial Sequence
  Synthetic construct
aaccgggactctggggtcccagacagattcagtggcagtgggtcaggcactgacttcacactgaaaatcagcagggtggaggctgaggatgttggagtttattactgc

SEQ ID NO: 10221 - DNA, 108 bp, Artificial Sequence
  Synthetic construct
aaccgggactctggggtcccagacagattcagcggcagtgggtcaggcactgatttcacactgaaaatcagcagggtggaggctgaggatgttggggtttattactgc

SEQ ID NO: 10222 - DNA, 108 bp, Artificial Sequence
  Synthetic construct
agtttgaaagcaggggtcccatcaagattcagtggaagtggctctggaaaaaagtttactttcaccatcaataacctgcagcctgaagatattgcaacatattactgt

SEQ ID NO: 10223 - DNA, 108 bp, Artificial Sequence
  Synthetic construct
aatttggaagcaggggtcccatctaggttcagtggcggtggatctgggacagattttactctcaccatcaacagcctacagcctgaagatattgcaacatattactgt

SEQ ID NO: 10224 - DNA, 108 bp, Artificial Sequence
  Synthetic construct
agattggaaagtggggtcccatttcggttcagtggcagtggatctgggacggctttcactctcagcatcagcagcctgcagcctgaagattttgcaacttattactgt

SEQ ID NO: 10225 - DNA, 108 bp, Artificial Sequence
  Synthetic construct
aacagggccagtggcatcccagccaggttcagtggcagtgggtctgggacagacttcattctcaccatcaccagcctagagcctgaagattttgctgtttattactgt

SEQ ID NO: 10226 - DNA, 108 bp, Artificial Sequence
  Synthetic construct
agtttacaaagtggtgtcccctcaagattcactggcagtggatctgggacagatttcactctcaccatcaacagtctgcaacctgaagattttgcaacctacttctgt

SEQ ID NO: 10227 - DNA, 108 bp, Artificial Sequence
  Synthetic construct
catttacacagtggggtcccatcaagattcggtggcggtggatctgggacagagttcaccctcaccatcggcagtctacaacctgaagattttgcaacttactactgt

SEQ ID NO: 10228 - DNA, 108 bp, Artificial Sequence
  Synthetic construct
agtttgcaaagtggggtcccatcaaggttcagtggcagtggatctgggacagatttcactctcaccatcagcagtctgcaacctgaagattttgcaacttactactgt

SEQ ID NO: 10229 - DNA, 108 bp, Artificial Sequence
  Synthetic construct
agattagaaaccggggtcccatcaaggttcagtggcagtgcatctggggcagacttcactctcaccatcagcagtctgcaacctgaagattttgcaacttacttctgt

SEQ ID NO: 10230 - DNA, 108 bp, Artificial Sequence
  Synthetic construct
aatttagagacaggggtctcatcaaggttcagtggaagtggatctgggacagatttcactctcaccatcaacagcctgcagcctgaagatattgcaacatatttctgt

SEQ ID NO: 10231 - DNA, 108 bp, Artificial Sequence
  Synthetic construct
accagggccactggcatcccagacaggttcattggcagtgggtctgggacagacttcactctcaccatcaacagactggagcctgaagattttgcagtgtattactgt

SEQ ID NO: 10232 - DNA, 108 bp, Artificial Sequence
  Synthetic construct
agcagggccactggcatcccagacaggttcagtggcagtgggtctgggacagacttcactctgaccatcagcagactggagcctgaagattttgcaatatattactgt

SEQ ID NO: 10233 - DNA, 108 bp, Artificial Sequence
  Synthetic construct
agcagggccactggcatcccagacaggttcagtggcagtgggtctgggacagacttcactctcaccatcagcagactggagcctgaagattttgcagtatattactgt

SEQ ID NO: 10234 - DNA, 108 bp, Artificial Sequence
  Synthetic construct
aatctggaaacaggcgtgccttctaggttctccggctctgggagtggaactgacttcacctttacaatctctagtctgcagccagaggatattgctacatatttctgt

SEQ ID NO: 10235 - DNA, 108 bp, Artificial Sequence
  Synthetic construct
aatttagaaagtggggtcccattaaggttcagcggcagtggatctgggacagaattcactctcaccatcagcagcctgcagcctgatgattttgcagtttattactgc

SEQ ID NO: 10236 - DNA, 108 bp, Artificial Sequence
  Synthetic construct
accagggtcactggtatcccagccaggttcagtggcagtgggtctgggacagagttcactctcaccatcagcagcctgcagtttgaggattttgcagtttattactgt

SEQ ID NO: 10237 - DNA, 108 bp, Artificial Sequence
  Synthetic construct
accagggccactggtatcccagccaggttcagtggcagtggatctgggacaaatttcactctcaccatcagcagcctgcagtctgaagattttgcagtttattactgt

SEQ ID NO: 10238 - DNA, 108 bp, Artificial Sequence
  Synthetic construct
accagggccactggtatcccagccaggttcagtggcagtgggtctgggacagagttcactctcaccatcagcagcctgcagtctgaagattttgcagtttattactgt

SEQ ID NO: 10239 - DNA, 108 bp, Artificial Sequence
  Synthetic construct
accagggccactgttatcccagccaggttcagtggcagtgggtctgggacagagttcactctcaccatcagcagcctgcaatctgaagattttgcagtttattactgt

SEQ ID NO: 10240 - DNA, 108 bp, Artificial Sequence
  Synthetic construct
agtttagaaagtggggtcccatcaaggttcagcggcagtggatctgggacagaattcactctcaccatcagcagcctgcagcctgatgattttgcaacttattactgc

SEQ ID NO: 10241 - DNA, 108 bp, Artificial Sequence
  Synthetic construct
tccagggccaccggtatcccagccaggttcagtggcagtgggtctgggacagacttcactctcaccatcagcagcctgcagtctgaagattttgcagtttattactgt

SEQ ID NO: 10242 - DNA, 108 bp, Artificial Sequence
  Synthetic construct
agcagggccaccggcgtcccagacaggttcagtggcagtgggtctgggacagacttcactctcaccatcagcagactggagcctgaagattctgcagtgtattactgt

SEQ ID NO: 10243 - DNA, 108 bp, Artificial Sequence
  Synthetic construct
agcagggccactggcatcccagacaggttcagtggcagtgggtctgggacagacttcactctcaccatcagcagactggagcctgaagattttgcagtgtattactgt

SEQ ID NO: 10244 - DNA, 108 bp, Artificial Sequence
  Synthetic construct
acccgggaatctggggtccctgaccgattcagtggcagcgggtctgcgacagatttcactctcaccatcagcagcctgcaggctgaagatgtggcaatttattactgt

SEQ ID NO: 10245 - DNA, 108 bp, Artificial Sequence
  Synthetic construct
actttgcaaagtggggtcccatcaaggttcagtggcagtggatctgggacagatttcactctcaccatcagttgcctgcagtctgaagattttgcaacttattactgt

SEQ ID NO: 10246 - DNA, 108 bp, Artificial Sequence
  Synthetic construct
actttgcaaagtggggtcccatcaaggttcagcggcagtggatctgggacagatttcactctcaccatcagctgcctgcagtctgaagattttgcaacttattactgt

SEQ ID NO: 10247 - DNA, 108 bp, Artificial Sequence
  Synthetic construct
agccgggaatccggggtccctgaccgattcagtggcagcgggtctgggacagatttcactctcaccatcagcagcctgcaggctgaagatgtggcagtttattactgt

SEQ ID NO: 10248 - DNA, 108 bp, Artificial Sequence
  Synthetic construct
gagaggccctcagggatccctgagcgattctctggctccagctcagggacaacagtcacgttgaccatcagtggagtccgggcagaagacgaggctgactattattgt

SEQ ID NO: 10249 - DNA, 108 bp, Artificial Sequence
  Synthetic construct
aatcggccctcagggatcccagaccgattctctggctccaggtcaggaaacacagcttccttgaccatcactggggctcgggcggaagatgaggctgactattactgt

SEQ ID NO: 10250 - DNA, 108 bp, Artificial Sequence
  Synthetic construct
gagaggccctcagggatccctgagcgattctctggctccagctcagggacaacagtcacgttgaccatcagtggagtccaggcagaagacgaggctgactattactgt

SEQ ID NO: 10251 - DNA, 108 bp, Artificial Sequence
  Synthetic construct
gcccggccctcagggatccctgagcgattctctggatccaattctgggaacacggccaccctgaccatcagcagggtcgaaggcggggatgaggccgactattactgt

SEQ ID NO: 10252 - DNA, 108 bp, Artificial Sequence
  Synthetic construct
aatcggccctcagggatttctaatcggttctctggctccaagtctggcaacacggcctccctgaccatctctgggctccaggctgacgacgaggctgattattactgc

SEQ ID NO: 10253 - DNA, 108 bp, Artificial Sequence
  Synthetic construct
aatcggccctcagggatttctaatcgcttctctggctccaagtctggcaacacggcctccctgaccatctctgggctccaggctgacgacgagggtgattattactgc

SEQ ID NO: 10254 - DNA, 108 bp, Artificial Sequence
  Synthetic construct
aatcggccctcagggatttctaatcgcttctctggctccaagtctgacaacacggcctccctgaccatctctgggctccaggctgacgacgaggctgattattactgc

SEQ ID NO: 10255 - DNA, 108 bp, Artificial Sequence
  Synthetic construct
aatcggccctcagggatttctaatcgcttctctggctccaagtctggcaacacggcctccctgaccatctctgggctccaggctgacgacgacactgattattactgc

SEQ ID NO: 10256 - DNA, 108 bp, Artificial Sequence
  Synthetic construct
aatcggccctcagggatttctaatcgcttctctggctccaagtctgacaagacggcctccctgaccatctctgggctccaggctgacgacgaggctgattattactgc

SEQ ID NO: 10257 - DNA, 108 bp, Artificial Sequence
  Synthetic construct
aatcggccctcagggatttctaatcgcttctctggatccaagtctggcaacacggcctccctgaccatctctgggctccaggctgacgacgaggctgattattactgc

SEQ ID NO: 10258 - DNA, 108 bp, Artificial Sequence
  Synthetic construct
actttggcaacaggcgccccatcaaggttcagtggaagtggatctgggacacattttactctcaccatcagcagactgcagcctgatgatattgcaacatactactgt

SEQ ID NO: 10259 - DNA, 108 bp, Artificial Sequence
  Synthetic construct
agcagggccgctggcatcccagagaggttccgtggcggcgggtctgggacagacttcactctcaccatcagcagactggagcctgaagattttgcagtctattactgt

SEQ ID NO: 10260 - DNA, 108 bp, Artificial Sequence
  Synthetic construct
tcccgggaatccggggtccctgaccgatttagtggcagcggatctgggacagatttcactctcaccatcagcagcctgcaggctgaagatgtggcactttattattgt

SEQ ID NO: 10261 - DNA, 108 bp, Artificial Sequence
  Synthetic construct
aacagggccactggcatccccgacaggttcactggcagtgggtctgggacagacttcactctcaccatcagcagactggagcctgacgattttgcagtgtattactgt

SEQ ID NO: 10262 - DNA, 108 bp, Artificial Sequence
  Synthetic construct
agtagggccactggcatcccagacaggttcagtggcagtgggtctgggacagacttcactctcaccatcagcagactggagcctgacgattttgcagtgtattattgt

SEQ ID NO: 10263 - DNA, 108 bp, Artificial Sequence
  Synthetic construct
aacagggccactggcatcccagccaggttcagtggcagtgggtctgggacagacttcactctcaccatcagcagcctagagcctgaagattttgcagtttattactgt

SEQ ID NO: 10264 - DNA, 108 bp, Artificial Sequence
  Synthetic construct
aaccggccctcagggatcccagaccgattctctggctccagctcaggaaacacagcttccttgaccatcactggggctcaggcggaagatgaggctgactattactgt

SEQ ID NO: 10265 - DNA, 108 bp, Artificial Sequence
  Synthetic construct
gaccggccctcagggatccctgagcgattctctggctccaactctgggaacacggccaccctgaccatcagcagggtcgaagccggggatgaggccgactattattgt

SEQ ID NO: 10266 - DNA, 108 bp, Artificial Sequence
  Synthetic construct
accagggccactggtatcccagccaggttcagtggcagtgggtctgggacagagttcactctcaccatcagtagcctgcagtctgaagattttgcagtttattactgt

SEQ ID NO: 10267 - DNA, 108 bp, Artificial Sequence
  Synthetic construct
cagcggccctcaggggtccctgaccgcttctctggctccaagtctggcacctcagcctccctggccatcagtgggctccggtccgaggatgaggctatttattactgt

SEQ ID NO: 10268 - DNA, 108 bp, Artificial Sequence
  Synthetic construct
tatcgggcctctggagtcccagacaggttcagtggcagtgggtcaggcactgatttcacactgaaaatcagcagggtggaggctgaggatgttggagtttattactgc

SEQ ID NO: 10269 - DNA, 108 bp, Artificial Sequence
  Synthetic construct
aagcggccctcaggggtccctgatcgcttctctggctccaagtctggcaacacggcctccctgaccatctctgggctccaggctgaggatgaggctgattattactgc

SEQ ID NO: 10270 - DNA, 108 bp, Artificial Sequence
  Synthetic construct
catttacaaagtggggtcccatcaaggtttagcggcagtggatctggcacagatttcactctcaccatcagcatcctgcggcctgaagattttgcaacgtattactgt

SEQ ID NO: 10271 - DNA, 29 bp, Artificial Sequence
  Synthetic construct
aggctgacgacgaggctgattttcagtgc

SEQ ID NO: 10272 - DNA, 108 bp, Artificial Sequence
  Synthetic construct
gcgaggccctcaggcatccctgcccgattctctggctccggctcagggacaacagctacattgaccatcagtggagtccaggcagaagacgaggctgattattactgt

SEQ ID NO: 10273 - DNA, 108 bp, Artificial Sequence
  Synthetic construct
aagcggccctcaggggtccctgatcgcttctctggctccaagtctggcaacacggcctccctgaccgtctctgggctccaggctgaggatgaggctgattattactgc

SEQ ID NO: 10274 - DNA, 40 bp, Artificial Sequence
  Synthetic construct
caccgacctccaaactggggacgaggccgactattactgc

SEQ ID NO: 10275 - DNA, 114 bp, Artificial Sequence
  Synthetic construct
caaaggccctctggggtccccgatcgcttctctgcctccgtcgacggctcctccaactctgcctccctcaccatctctggactgcagactgaggacgaggctgactactactgt

SEQ ID NO: 10276 - DNA, 108 bp, Artificial Sequence
  Synthetic construct
agattggaaagtggggtcccatccaggttcagtggcagtggatctgggacggattacactctcaccatcagcagcctgcagcctgaagattttgcaacttattactgt

SEQ ID NO: 10277 - DNA, 108 bp, Artificial Sequence
  Synthetic construct
tttttgaaaagtggagtcccatcaaggttcagcggcagtggatctgggacagaattcactctcacaatcaacagcctgcagcctgaagattttgcaacttatttctgt

SEQ ID NO: 10278 - DNA, 108 bp, Artificial Sequence
  Synthetic construct
agtttagaaagtggggtcccatcaaggttcagcggcagtggatctgggacagaattcactctcaccatcagcagcctgcagcctgatgactttgcaacttattactgc

SEQ ID NO: 10279 - DNA, 108 bp, Artificial Sequence
  Synthetic construct
aatcggccctcaggggtccctgaccgattctctggctccaagtctggcacctcagcctccctggccatcactgggctccaggctgaggatgaggctgattattactgc

SEQ ID NO: 10280 - DNA, 108 bp, Artificial Sequence
  Synthetic construct
acgcgggaagccggggtccctgaccgattcagtggcagcgggtctgggacagatttcactctcaccatcagcagcctgcaggctgaagatgtggcagtttattactgt

SEQ ID NO: 10281 - DNA, 108 bp, Artificial Sequence
  Synthetic construct
aacagggccactggcatcccagacaggttcagtggcagtgggtctgggacagacttcagtctcaccatcagccgactggagccggaagattttgcaatgtattactgt

SEQ ID NO: 10282 - DNA, 108 bp, Artificial Sequence
  Synthetic construct
aagcggccctcaggggtttctaatcgcttctctggctccaagtctggcaacacggcctccctgaccatctctgggctccaggctgacgacgaggctgattattactgc

SEQ ID NO: 10283 - DNA, 108 bp, Artificial Sequence
  Synthetic construct
agtttgcaaaatggcgtcccatcgaggttcagaggcagtggatctgagacagagttcactctcaccatcagcaacctgcagcctgatgattctgcaacttattactgc

SEQ ID NO: 10284 - DNA, 108 bp, Artificial Sequence
  Synthetic construct
gagcggccctcagggatccctgagcgattctccggctccagctcagggaccacagtcaccttgaccatcagcggggcccaggttgaggatgaggctgactattactgt

SEQ ID NO: 10285 - DNA, 108 bp, Artificial Sequence
  Synthetic construct
gaccggccctcagggatccctgaacgtttctccggctccaattctgagactatggccaccctgaccatcgactgggtcgaggccggggatgaggccgactatttctgt

SEQ ID NO: 10286 - DNA, 108 bp, Artificial Sequence
  Synthetic construct
agcagggccactggcatcccagacaggttcagtggcagtgggtctgggacagacttcacgctcaccatcagcagactggagcctgaggattttgcagtgtatttctgt

SEQ ID NO: 10287 - DNA, 108 bp, Artificial Sequence
  Synthetic construct
accagggccactggtgtcccagacaggttcagtggcagtgggtctgggacagagttcactctcaccatcagcagcctgcagtctgaagattttgcagtttattactgt

SEQ ID NO: 10288 - DNA, 108 bp, Artificial Sequence
  Synthetic construct
attctgcaggcaggggtctcatcgcgtttcagcggcagtggatctgggacaaatttcactctctccataagaaacctggagcctgaggatgttggcacttattactgt

SEQ ID NO: 10289 - DNA, 108 bp, Artificial Sequence
  Synthetic construct
agcagggccactggcatcccagacaggttcagtggcagtgggtctgggacagacttcactctcaccatcagcagactggagcctgaagattttgcagtgttttactgt

SEQ ID NO: 10290 - DNA, 108 bp, Artificial Sequence
  Synthetic construct
agtttagaaagtggggtcccatcaaggttcagcggcagcggatctgggacagaattcactctcaccatcagcagcctgcagcctgatgattttgcaacttattactgc

SEQ ID NO: 10291 - DNA, 108 bp, Artificial Sequence
  Synthetic construct
cagcggccctcaggggtccctgaccgaatctctggctccaagtctggcacctcagcctccctggccatcagtggactccagtctgaggatgaggctgattattactgt

SEQ ID NO: 10292 - DNA, 108 bp, Artificial Sequence
  Synthetic construct
gagcggccctcagggatccctgagcgattctccggctccagctcagggaccacagtcaccttgaccatcagccgggcccaggttgaggatgaggctgactattactgt

SEQ ID NO: 10293 - DNA, 108 bp, Artificial Sequence
  Synthetic construct
gagaggccctcagggatccctgagcgattctctggctccaattcagggacaacagtgacgttgaccatcactggagtccaggcagaagacgaggctgactattactgt

SEQ ID NO: 10294 - DNA, 108 bp, Artificial Sequence
  Synthetic construct
aagcggccctcaggggtccctgatcgcttctctggctccaagtctggcaacacggcctccctgaccgtctctggcctccaggctgaagatgagggtgattattactgc

SEQ ID NO: 10295 - DNA, 108 bp, Artificial Sequence
  Synthetic construct
actttagaaaaaggggtcccatcacggttcagcggcagtggatctgggacagaattcactctcaccattagcagtctgcagcctgatgattttgcaacttacttctgt

SEQ ID NO: 10296 - DNA, 108 bp, Artificial Sequence
  Synthetic construct
aatcggccctcaggggtccctgaccgattctctggctccaagtctggcacctcagcctccctgataatcactgggctccagactgaggatgaggctgtttattattgc

SEQ ID NO: 10297 - DNA, 108 bp, Artificial Sequence
  Synthetic construct
actcgggcctccggggtccctgacaggttcattggcactggatcaggcattgattttacactgaaaatcaccagggtgcaacctgaagatgttggggtgtattactgc

SEQ ID NO: 10298 - DNA, 108 bp, Artificial Sequence
  Synthetic construct
aacagggccactggcatcccagacaggttcagaggcagtgggtctgggacagacttcactctcaccatcagcagactggagcctgaagattttgcagtgtattactgt

SEQ ID NO: 10299 - DNA, 114 bp, Artificial Sequence
  Synthetic construct
caaagaccctctggggtccctgatcggttctctggctccatcgacagctcctccaactctgcctccctcaccatctctggactgaagactgaggacgaggctgactactactgt

SEQ ID NO: 10300 - DNA, 108 bp, Artificial Sequence
  Synthetic construct
actttagaaagtggggtcccatcaaggttcagcggcagtggatctgggacagaattcactctcacgatcagcagcctgcagcctgatgattttgcatcttattactgc

SEQ ID NO: 10301 - DNA, 108 bp, Artificial Sequence
  Synthetic construct
aatttagaaagtggggtcccatcaagattcagcggcagtggatctgggacagaattcactctcaccatcagcagcctgcagcctgatgattttgcaacttattactgc

SEQ ID NO: 10302 - DNA, 108 bp, Artificial Sequence
  Synthetic construct
aagcggccctcagggatccctgaccgattctctggctccaactctggaaacacagccactctgaccatcagcgggacccaggctatggatgaggctgactattactgt

SEQ ID NO: 10303 - DNA, 108 bp, Artificial Sequence
  Synthetic construct
accagggccactggtgtcccagcccggttcagtggcactgggtctgggacagagttcttgctcaccatcaccagcctgcagtctgaagatttcgcagtttattattgt

SEQ ID NO: 10304 - DNA, 108 bp, Artificial Sequence
  Synthetic construct
agcagggccgctggcatcccagacaggttcagtggcagtgggtctggggcagacttcgctctcaccatcaccagactggagcctgaagattttggggtgtattactgt

SEQ ID NO: 10305 - DNA, 108 bp, Artificial Sequence
  Synthetic construct
gcccgggagtccggggtccctgcccgatttagtgccagcgcctctgggacagatttcactctcaccatcgacagcctgcaggctgaggatgtggccgtttattactgt

SEQ ID NO: 10306 - DNA, 108 bp, Artificial Sequence
  Synthetic construct
aaccgggactctggggtcccagacagattcagcggcagtggggcaggctctgagttcacgctgacaatcagtagcgtggaggtcgaggatgttggcatttattactgc

SEQ ID NO: 10307 - DNA, 108 bp, Artificial Sequence
  Synthetic construct
actttggagacaggggtcccatcaaggatcagtggaactggatctgggacaacttttactttcaccatcaccagcctgcagcctgaagatattgcaacatattactgt

SEQ ID NO: 10308 - DNA, 108 bp, Artificial Sequence
  Synthetic construct
agcagggcccctggcatcccagagaggttcagtgtcagtgggtctgggacagatttcactctcaccatcagcagtctggagcctgaagattttgcagtgtattactgt

SEQ ID NO: 10309 - DNA, 108 bp, Artificial Sequence
  Synthetic construct
cagcggccctcagatgtctctgaccgattctctggctctaagtctggcaactcagcctccctgaccatcagtggactccggtccgaggatgaggcagactattattgt

SEQ ID NO: 10310 - DNA, 108 bp, Artificial Sequence
  Synthetic construct
actttgcaaagtcatgtcccatctagattcagtggcagtggatccgggacagatttcactttcaccatcagcagtctgcaacctgaagattttgcgacatattactgt

SEQ ID NO: 10311 - DNA, 108 bp, Artificial Sequence
  Synthetic construct
actcgctcttctggggtccctgatcgcttctctggctccatccttggaaacaaagctgccctcaccatcacgggggcccaggcagatgatgaatctgattattactgt

SEQ ID NO: 10312 - DNA, 108 bp, Artificial Sequence
  Synthetic construct
agcagggccactggcatcccagacaggttcagtggcagtgggtctgggacagacttcgctctcaccatcaacagactggagcctgaggattttgcagtgtattactgt

SEQ ID NO: 10313 - DNA, 108 bp, Artificial Sequence
  Synthetic construct
agcagggccactggcatcccagacaggttcagtggcagtgggtctgggacagacttcactctcaccatcagcagactggagcctgaagattttgcagtgtatttctgt

SEQ ID NO: 10314 - DNA, 108 bp, Artificial Sequence
  Synthetic construct
actttaaaaagtggggtcccgtcaaggttcagcggcagtggatctgggacagacttcactctcaccatcagcagcctgcagcctgatgattttgcaacttattactgc

SEQ ID NO: 10315 - DNA, 108 bp, Artificial Sequence
  Synthetic construct
accagggccactggcatcccagacaggttcggtggcagcgggtctgggacagacttcacgctcaccatcagcagactggagcctgaagattttgcagtctatttctgt

SEQ ID NO: 10316 - DNA, 108 bp, Artificial Sequence
  Synthetic construct
cagtccttctcaggggtcccctcgaggttcagtggcagtggatctgggacagatttcaccctcaccatcaatagcttggaagctgaagatgctgcaacgtattactgt

SEQ ID NO: 10317 - DNA, 108 bp, Artificial Sequence
  Synthetic construct
accagggccgctggcatcccagccaggtttagtggcagtgggtctgggacacacttcactctcaccatcagcagcctagagcctgaagattttggagtttattactgt

SEQ ID NO: 10318 - DNA, 108 bp, Artificial Sequence
  Synthetic construct
agtttacaaagtggggtcccatcaaggttcagcggcagtggatctggcacagatttcactctcaccatcagcagcctgcagcctgaagattttgcaacttattactgt

SEQ ID NO: 10319 - DNA, 108 bp, Artificial Sequence
  Synthetic construct
aaccggttctctggggtcccagacagattcagtggcagtggggcagggacagatttcacactgaaaatcagcagggtggaagctgaggatgtcggggtttattactgc

SEQ ID NO: 10320 - DNA, 108 bp, Artificial Sequence
  Synthetic construct
actttacaaagtggggtcccgtcaaggttcagcggcagtgtgtctggcacagatttcactctcaccatcagcagccttcagcctgaagattttgccacttattactgt

SEQ ID NO: 10321 - DNA, 114 bp, Artificial Sequence
  Synthetic construct
caaagaccctctggggtccctgatcggttctctggctccatcgacagctcctccaactctgcctccctcaccatctctggactgaagactgaggacgcggctgactactactgt

SEQ ID NO: 10322 - DNA, 108 bp, Artificial Sequence
  Synthetic construct
tccagggccactgatatcccagtcaggttccgtggcagtgggtctgggacagagttcactctcaccatcagcagcctgcagtctgaagattttgcagtttattactgt

SEQ ID NO: 10323 - DNA, 108 bp, Artificial Sequence
  Synthetic construct
gaccggccctcagggatccctgagcgattctctggctccaactctgggaacacggccaccctgaccatcaccagagtcgaagccggggatgaggccgactattcctgt

SEQ ID NO: 10324 - DNA, 108 bp, Artificial Sequence
  Synthetic construct
aagcggccctcaggggtccctgatcgcttctctggctccaagtctggcaacacggcctccctgaccatctctgggctccaggctgaagatgaggctgattattactgc

SEQ ID NO: 10325 - DNA, 108 bp, Artificial Sequence
  Synthetic construct
acccgagaatccggggtccctgaccgattcagtggcagcgggtctgggacagatttcactctcaccatcaacagcctgcaggctgaagatgtggcagtttattactgt

SEQ ID NO: 10326 - DNA, 108 bp, Artificial Sequence
  Synthetic construct
actttgcaaagtggagtcccgtcaaggttcagtggcagtggttctgggacagatttcactctcaccatcagcagtctgcaacctgaagattttgcgatttacttctgt

SEQ ID NO: 10327 - DNA, 108 bp, Artificial Sequence
  Synthetic construct
accagggccactggtatcccagccaggttcagtggcagtgggtctgggacagagttcactctcaccatcagcagcctgcagtctgaagatttggcggtttattactgt

SEQ ID NO: 10328 - DNA, 108 bp, Artificial Sequence
  Synthetic construct
agtttgcaaagtggggtcccatcgaggttcagcggcagtggatctgggacagaattcactctcacaatcagcagcctgcagcctgaagattttgcaacctattactgt

SEQ ID NO: 10329 - DNA, 108 bp, Artificial Sequence
  Synthetic construct
actcgggcctccggagtccctgccaggttccgtggcactggatcaggcacagattttacactgagaatcagcagagtggaggctgaggatgttggggtttattactgc

SEQ ID NO: 10330 - DNA, 108 bp, Artificial Sequence
  Synthetic construct
aatttgcaagatggagtcccatcaaggttcagtggcagtggatctgggacagatttcactctcaccatcagtagtctccaacctgaagattttgcaacttactactgt

SEQ ID NO: 10331 - DNA, 108 bp, Artificial Sequence
  Synthetic construct
aaacggccctcagggatcccagaccgattctctggctccagctcaggaaacacagataccttgaccatcactggggttcaggcggaagatgagggtgactattattgt

SEQ ID NO: 10332 - DNA, 108 bp, Artificial Sequence
  Synthetic construct
aacagggccactggcatcccagccaggttcagtggcagtgggtctgggacagacttcactctcaccatcagcagcctagagcctgaagattttgcactttattactgt

SEQ ID NO: 10333 - DNA, 108 bp, Artificial Sequence
  Synthetic construct
accagggccactggtatcccagccacgttcagtggcagtgggtctgggacagagttcactctcaccatcagcagcctgcagtctgaagattttgcagtttattactgt

SEQ ID NO: 10334 - DNA, 108 bp, Artificial Sequence
  Synthetic construct
actttgcaatcaggggtcccatctcggttcagtggcactggatctgggacagatttcactctcaccatcagcagcctgcagcctgaagatgttgcaacttattactgt

SEQ ID NO: 10335 - DNA, 108 bp, Artificial Sequence
  Synthetic construct
actttgcattcaggggtcccatctcggttcagtggcagtggttctgggacagatttcactctcaccatcagcagcctgcagcctgaagatgttgcaacttattactgt

SEQ ID NO: 10336 - DNA, 108 bp, Artificial Sequence
  Synthetic construct
aaccggccctcagggatcgcagaccgattctctggctccatctcaggaaacacagcttccttgaccatcactggggctcaggcggaagatgaggctgactattactgt

SEQ ID NO: 10337 - DNA, 108 bp, Artificial Sequence
  Synthetic construct
gagcggccctcaggggtccctgaccgtttctctggctccaagtctggcacctcagcctccctggccatcagtgggctccaggctgaggatgaggctgattattactgt

SEQ ID NO: 10338 - DNA, 108 bp, Artificial Sequence
  Synthetic construct
gaccggccctcagggatccctgagcgattctctggctccaaatctgggaacacggccaccctgaccatcggcagggtcgaagccggggatgaggccgacttttactgt

SEQ ID NO: 10339 - DNA, 108 bp, Artificial Sequence
  Synthetic construct
caacggcccacaggggtccccgaccgattcctcggctccaactctggcacctcagcctccctggccatcagtgacctccagactgacgatgaggctgattattactgt

SEQ ID NO: 10340 - DNA, 108 bp, Artificial Sequence
  Synthetic construct
actttgcagtcaggggtcccatctcggttcagtggcagtggatctgggacagaattcactctcaccatcagcagcctgcagcctgaggatgttgcaacttattactgt

SEQ ID NO: 10341 - DNA, 69 bp, Artificial Sequence
  Synthetic construct
aggtcaggaaacacagcttccttgaccatcactggggctcgggcggaagatgaggctgactattactgt

SEQ ID NO: 10342 - DNA, 108 bp, Artificial Sequence
  Synthetic construct
agtttacaaagtggggtcccatcacggttcagcggcagtggatctgggacagaattcactctcaccatcagcagcctgcagcctgatgattttgcaacttattactgc

SEQ ID NO: 10343 - DNA, 108 bp, Artificial Sequence
  Synthetic construct
aggttacaaagtggggtcccaccaaggtttagcggcagtggatctgggacagaattcacactcaccatcagcagtctgcagcctgatgattttgcaacttattactgc

SEQ ID NO: 10344 - DNA, 108 bp, Artificial Sequence
  Synthetic construct
gaccggccctcagggatccctgagcgattttctggctccaactctgggaacacggccaccctgaccatcagcagggtcgaggccggggatgaggccgactattactgt

SEQ ID NO: 10345 - DNA, 108 bp, Artificial Sequence
  Synthetic construct
cagcggccctcaggagtccctcatcgtttctctggctctaagtctggcaacacggcctccctgaccatctctgggctccaggctgacgatgaggctgactattactgc

SEQ ID NO: 10346 - DNA, 108 bp, Artificial Sequence
  Synthetic construct
gaccggccctcagggatccctgagcgattctctggctccaactctgggaactcggccaccctgaccatcagcagggtcgaggccggggatgaggccgactactactgt

SEQ ID NO: 10347 - DNA, 108 bp, Artificial Sequence
  Synthetic construct
agcaagggggacgggatccctgatcgcttctcaggctccagctctggggctgagcgctacctcaccatctccagcctccagtctgaggatgaggctgactattactgt

SEQ ID NO: 10348 - DNA, 108 bp, Artificial Sequence
  Synthetic construct
actttgcaatcaggggtcccatctcggttcagcggcagtggatctgggacagatttcactctcaccatcagcagcctgcagcctgaagatgttgcaacttattactgt

SEQ ID NO: 10349 - DNA, 108 bp, Artificial Sequence
  Synthetic construct
agtttgccgagtggggtcccatcaagattcactggcagtggatctgggacagatttcactctcaccatcagcagtctgcaacctgaagattttgcaacttactactgt

SEQ ID NO: 10350 - DNA, 108 bp, Artificial Sequence
  Synthetic construct
gagaggccctcagggatccctgagcgattctctggctccacctcagggacaacagtcacgttgaccataagtggagtccaggcagaagacgaggctgactattattgt

SEQ ID NO: 10351 - DNA, 108 bp, Artificial Sequence
  Synthetic construct
actttgcaaagtggggtcccatcaaggttcagtggcagtggatctgggacagatttcactctcaccatcagcagtctccaacctgaagattttgcaacttactactgt

SEQ ID NO: 10352 - DNA, 108 bp, Artificial Sequence
  Synthetic construct
agtgtccaaagtggggtcccatcgaggttcagcggcagtggatctggcacagatttcactctcaccatcagcagcctgcagcctgaagattttgcaacttattactgt

SEQ ID NO: 10353 - DNA, 108 bp, Artificial Sequence
  Synthetic construct
accagggccattgacatccccgccaggttcagtggcagtgggtctgggacagacttcactctcaccatcagcggcctggagcctgaagattttgcagtttattattgt

SEQ ID NO: 10354 - DNA, 108 bp, Artificial Sequence
  Synthetic construct
aacagggccactggcatcccagccaggttcagtggcagtgggtctgggacagacttcactctcaccatcagcagccttgagcctgaagattttgcagtttattactgt

SEQ ID NO: 10355 - DNA, 108 bp, Artificial Sequence
  Synthetic construct
aaccggccctcagggatcccagaccgattctctggctccagctcaggaaacacagcttccttgaccatcactggggctcaggcgaaagatgaggctgactattactgt

SEQ ID NO: 10356 - DNA, 114 bp, Artificial Sequence
  Synthetic construct
caaagaccctctggggtccctgatcggttctctggctccatcgacacctcctccaactctgcctccctcaccatctctggactgaagactgaggacgaggctgactactactgt

SEQ ID NO: 10357 - DNA, 108 bp, Artificial Sequence
  Synthetic construct
aatcggccctcagggatccccgaccgattctctggctccagctcaggaaccacagcttccttgaccatcactggggctcaggcggaagatgaggctgactattactgt

SEQ ID NO: 10358 - DNA, 108 bp, Artificial Sequence
  Synthetic construct
gaccggccctcagggatccctgagcgattctctggctccaactctgggaacacggccaccctgaccatcagcagggtcgaagccggggatgaggccgactattactgt

SEQ ID NO: 10359 - DNA, 108 bp, Artificial Sequence
  Synthetic construct
aagcggccctcagggatccctgagcgattctctggctccaactctgggaacacagccactctgaccatcagcgggacccaggctatggatgaggctgactattactgt

SEQ ID NO: 10360 - DNA, 108 bp, Artificial Sequence
  Synthetic construct
accagggccactggtatcccagccaggttcagtgccagtgggtctgggacagagttcactctcaccatcagcagcctgcagtctgaagattttgcagtttattactgt

SEQ ID NO: 10361 - DNA, 108 bp, Artificial Sequence
  Synthetic construct
agtttgcaaagtggggtcccatcaagattcagcggcagtggatctgggacagatttcactctcaccatcaccagtctgcaggctgaagactctgcaacttactattgt

SEQ ID NO: 10362 - DNA, 108 bp, Artificial Sequence
  Synthetic construct
aaccgggccactggcctcccagccaggttcagtggcagtgggtctgggacggatttcactctcaccatcagcagcctagagcctgacgattttgcagtttattactgt

SEQ ID NO: 10363 - DNA, 108 bp, Artificial Sequence
  Synthetic construct
actttgcaaagtggggtcccatcaaggttcagcggcagtggatctgggacagagttcactctcacaatcagcagcctgcagcctgaagattttgcaacttattactgt

SEQ ID NO: 10364 - DNA, 108 bp, Artificial Sequence
  Synthetic construct
aagcggccctcaggggtttctaatcgcttctctggctccaagtctggcaacacggcctccctgacaatctctgggctccaggctgaggacgactctgattattactgc

SEQ ID NO: 10365 - DNA, 108 bp, Artificial Sequence
  Synthetic construct
accagggccactggtatcacagccaggttcagtggcagcgggtctgggacagagttcactctcaccatcagcagcctgcagtctgaggattttgcagtttattactgt

SEQ ID NO: 10366 - DNA, 108 bp, Artificial Sequence
  Synthetic construct
agtttagagggtggggtcccatcaagattcagcggcagtagatctggtacagaattcactctcaccatcagcggcctgcagtctgatgattttgcaacttattactgc

SEQ ID NO: 10367 - DNA, 28 bp, Artificial Sequence
  Synthetic construct
gactgacgatgaggctgattattactgt

SEQ ID NO: 10368 - DNA, 108 bp, Artificial Sequence
  Synthetic construct
attttagaaagtggggtcccatccacattcagcggcagtggatctgggacagaattcactctcaccatcaccagcgtgcagcctgatgattctgcaacttattactgc

SEQ ID NO: 10369 - DNA, 108 bp, Artificial Sequence
  Synthetic construct
gaccggccctcggggatccctgagcgattttctggctccaactctggtaacacggccaccctgaccatcagcagggtcgaggccggggatgaggccgactatttctgt

SEQ ID NO: 10370 - DNA, 108 bp, Artificial Sequence
  Synthetic construct
accttaaaaagtggggtcccatcaaggttcagcggcagtggatcagggacagaattcactctcaccatcagaagcctgcagcctgatgattttggaacttactactgc

SEQ ID NO: 10371 - DNA, 108 bp, Artificial Sequence
  Synthetic construct
cagcggccctcaggggtccctgaccgattctctggctccaagtctggcacctcagcctccctggccatcagtggactccagtctgaggatgaggctgattattactgt

SEQ ID NO: 10372 - DNA, 108 bp, Artificial Sequence
  Synthetic construct
accagggccactggtatcccagccaggttcagtggcagtgggtctgggacagagttcaatctcaccatcagcagcctgcagcctgaagattttgcagtttattactgt

SEQ ID NO: 10373 - DNA, 108 bp, Artificial Sequence
  Synthetic construct
agcagtgacattgggatttctaatcgcttctctggctccaagtctggcaacacggcctccctgaccatctctgggctccaggctgacgacgaggctgattattactgc

SEQ ID NO: 10374 - DNA, 108 bp, Artificial Sequence
  Synthetic construct
actttacaaagtggggtcccatcaaggttcagcggcagtggatctgggacagaattcactctcaccatcagcagcctgcagcctgatgattttgcaatttattattgc

SEQ ID NO: 10375 - DNA, 108 bp, Artificial Sequence
  Synthetic construct
acccgggattccggggtccctgaccgattcagtggcagcgggtctgggacagatttcactctcaccatcagcagcctgcaggctgaagatgtggcagtttatttctgt

SEQ ID NO: 10376 - DNA, 108 bp, Artificial Sequence
  Synthetic construct
atccggccctcagggatctcagaccgattccatggctccacagttggaaacacagcttccctgcatatcgccggggttcaggcggacgatgagggcacttatttctgt

SEQ ID NO: 10377 - DNA, 108 bp, Artificial Sequence
  Synthetic construct
agtttagaaagtggggtcccatcaagattcagcggcagtggatctgggacagaattcactctcaccatcagcagcctgcagcctgatgattttgcaacttattactgc

SEQ ID NO: 10378 - DNA, 108 bp, Artificial Sequence
  Synthetic construct
aatcggccctcaggggtttctaatcgcttctctggctccaagtctggcaacacggcctccctgaccatctctgggctccaggctgaggacgaggctgattattactgc

SEQ ID NO: 10379 - DNA, 108 bp, Artificial Sequence
  Synthetic construct
aatcggccctcagggatcccagaccgattctctggctccagctcagggaacacagcttccttgaccatcactggggctcaggcggaagatgaggctgactattactgt

SEQ ID NO: 10380 - DNA, 92 bp, Artificial Sequence
  Synthetic construct
tttctaatcgcttctctggctccaagtctggcaacacggcctccctgaccatctctgggctccaggctgacgacgaggctgattattactgc

SEQ ID NO: 10381 - DNA, 108 bp, Artificial Sequence
  Synthetic construct
ctcagggccactggtgtcccagccaggttcagtggcagtgggtctgggacgcagttcactctcactatcagcagcctgcagtctgaagatttagccgtgtattactgt

SEQ ID NO: 10382 - DNA, 108 bp, Artificial Sequence
  Synthetic construct
aatcggccctcaggggtccctgaccgattctctggctccaagtctggcacctcagcttccctggccatcactgggctccaggctgaggatgaggctgattattactgc

SEQ ID NO: 10383 - DNA, 108 bp, Artificial Sequence
  Synthetic construct
accagggccactggcatcccagacaggttcggtggcagcgggtctgggacagacttcactctcaccatcagcagactggagcctgaagattttgcagtctatttctgt

SEQ ID NO: 10384 - DNA, 108 bp, Artificial Sequence
  Synthetic construct
gaccggccctcagggatccctgagcgattctctggctccagctctggcaacacggccaccctgatcatcagcgcggtcgaggccggggatgaggccgactattactgt

SEQ ID NO: 10385 - DNA, 108 bp, Artificial Sequence
  Synthetic construct
tctttagaaaatggggtcccatcaagattcagcggcagtgggtctgggacagacttcactctcaccatcagtagtctagagcctgaggattttgcagtttattactgt

SEQ ID NO: 10386 - DNA, 108 bp, Artificial Sequence
  Synthetic construct
agcagggccactggcgtcccagccaggttcagtggcagtgggtctgggacagacttcactctcaccatcagtagtctagagcctgaggattttgcagtttattactgt

SEQ ID NO: 10387 - DNA, 58 bp, Artificial Sequence
  Synthetic construct
cccctccacgacgctcttccgatctctcacactcctgcaggccgctgattattactgc

SEQ ID NO: 10388 - DNA, 108 bp, Artificial Sequence
  Synthetic construct
accagggccgctggtatcccagccaggttcagtggcagtgggtctgggacagagttcactctcaccatcagcagcctgcagtctgaagatcttgcagtttatgactgt

SEQ ID NO: 10389 - DNA, 108 bp, Artificial Sequence
  Synthetic construct
aatcgacagtcagggattcctgaccgattctctggctccaagtctggcacgtcagccaccctggacatcaccggactccagactgcggacgaggccgattattactgc

SEQ ID NO: 10390 - DNA, 108 bp, Artificial Sequence
  Synthetic construct
aagcggccctcaggggtttctaatcgcttctctggctccaagtctggcacgtcagccaccctggacatcaccggactccagactgcggacgaggccgattattactgc

SEQ ID NO: 10391 - DNA, 108 bp, Artificial Sequence
  Synthetic construct
aagcgaccctcagagattcctgaccgattctctggctccaagtctgacacgtcaggcaccctggacatcaccggactccagaccggggacgaggccgattattactgc

SEQ ID NO: 10392 - DNA, 108 bp, Artificial Sequence
  Synthetic construct
gaccggccctcagggattcctgagcgagtgtctggctccaactttgggaacacggccaccctgaccatcaccacggtcgaagccggggatgaggccgactacttctgt

SEQ ID NO: 10393 - DNA, 108 bp, Artificial Sequence
  Synthetic construct
actttgcagagtggggtcccatcaaggctcagtggcagtggatctgggacagaattcactctcaccatcaccagtctgcaacctgaagactttgcagcttactactgt

SEQ ID NO: 10394 - DNA, 108 bp, Artificial Sequence
  Synthetic construct
gacagggccactggcatcccagacaggttcagaggcagtggctatgggacagagttcactctcaccatcaccagactggagcctgaagactttgccgtatattactgt

SEQ ID NO: 10395 - DNA, 108 bp, Artificial Sequence
  Synthetic construct
catttaggaggtggggtcccatcgaggttcagcggcagtggatttgggacagaattcacgctcaccatcagcagcctgcagcctgatgattttgcgatttattactgc

SEQ ID NO: 10396 - DNA, 108 bp, Artificial Sequence
  Synthetic construct
aatcgggccccaggggtttctaatcgcttctctggctccaagcttggcaacacggcctccctgaccatctctgggctccagactgaggacgaggctgattatttctgc

SEQ ID NO: 10397 - DNA, 108 bp, Artificial Sequence
  Synthetic construct
aacaaggggagcggagttcctgatcgcttctcaggctccagctctggggctgaccgctacctcaccatctccaacctccagtctgaggatgaggctgatttttactgt

SEQ ID NO: 10398 - DNA, 108 bp, Artificial Sequence
  Synthetic construct
acccgggaatttggggtccctgaccgattcagtggcagcgggtctgggagagatttcactctcaccatcagcagcctgcaggctgaagatgtggcagtttattactgt

SEQ ID NO: 10399 - DNA, 108 bp, Artificial Sequence
  Synthetic construct
actttagaaagtggggtcccatcaaggttcagcggcagtggatctgggacagaattcactctcaccatcagcagcctgcagcctgatgattttgcaacttattactgc

SEQ ID NO: 10400 - DNA, 108 bp, Artificial Sequence
  Synthetic construct
actttgcaatctggggtcccatctcggttcagtggcagtggatctgggacagatttcactctcaccatcagcagcctgcagcctgaggatattgcaacttattactgt

SEQ ID NO: 10401 - DNA, 108 bp, Artificial Sequence
  Synthetic construct
actttagaaagtggggtcccatcaaggttcagcggcagtggatctgggacagaattcactctcaccgtcagcagcctgcagcctgatgattttgcaacttattactgc

SEQ ID NO: 10402 - DNA, 108 bp, Artificial Sequence
  Synthetic construct
agtttgcacgggggggtctcatcaaggtttggtggcagtggatccgggacagaattcactctcaccatcaacagcctgcagcctgaagattttgcaacttattactgc

SEQ ID NO: 10403 - DNA, 108 bp, Artificial Sequence
  Synthetic construct
aatttggagtatggggtccctgcaaggttcagcggcagtggatctgggacacacttcactctcaccatcaggagcctgcagcctgatgattttgcaacttattactgc

SEQ ID NO: 10404 - DNA, 108 bp, Artificial Sequence
  Synthetic construct
aacagggccactggcgtcccagccaggttcagtggcagtgggtctgggacagacttcactctcaccatcagcagcctagagcctgaagattttgcagtttattactgt

SEQ ID NO: 10405 - DNA, 108 bp, Artificial Sequence
  Synthetic construct
aacagaaactcctggacacctgcccggttctcaggctccctccttgggggcaaagctgccctgaccctttcgggtgcgctgcctgacgatgaggctgaatattactgc

SEQ ID NO: 10406 - DNA, 108 bp, Artificial Sequence
  Synthetic construct
aatttggaaagaggggtcccatcaaggttcagtggaagtggatctgggacagattttaatttaaccatcaccagcctgcagcctgaagatattgcaacatattactgt

SEQ ID NO: 10407 - DNA, 108 bp, Artificial Sequence
  Synthetic construct
actttagaaagtggggtcccatctaggttcagcggcagtggctctgggacagaattcactctcaccatcagcagcctgcagcctgatgattttgcaacttatttctgc

SEQ ID NO: 10408 - DNA, 108 bp, Artificial Sequence
  Synthetic construct
aaccgggactctggggccccggacagattcagcggcagtgggtcagtcactgatttcacactgaaaatcagcagggtagaggctgaagatgttggaatttattactgc

SEQ ID NO: 10409 - DNA, 108 bp, Artificial Sequence
  Synthetic construct
accagggccgcaggcatcccagacaggttcagtggcagcgggtctgggacagacttcactctcaccatcagcagactggaacctgaagatttcgcagtatattactgt

SEQ ID NO: 10410 - DNA, 108 bp, Artificial Sequence
  Synthetic construct
aatcggccctctggcatctctaagcgtttctctggctccaagtctggcaacacggcctccctcaccatctctaggctccagcctgaggacgaggctgattactactgc

SEQ ID NO: 10411 - DNA, 108 bp, Artificial Sequence
  Synthetic construct
acccgggattccggggtccctgaccgattcagtggcagcggatctgggacagatttcactctcacaatcagaggcgtgcaggctgaagatgtggcagtctattactgt

SEQ ID NO: 10412 - DNA, 108 bp, Artificial Sequence
  Synthetic construct
aatttacaaagtggggtcccatcaaggttcagcggcagtgggtctgggacagaattcactctcaccgtcaccagcctgcagcctgatgattttgcaacttactactgc

SEQ ID NO: 10413 - DNA, 108 bp, Artificial Sequence
  Synthetic construct
ttcagggccaccggtgtttctcccaggttcagtgccagtggggctggggcggatttcactctcaccatcagcagactgcagtctgaggattctgcagtctacttttgt

SEQ ID NO: 10414 - DNA, 108 bp, Artificial Sequence
  Synthetic construct
gccagggccgctggtgtcccagccaggttcagtgccagtgggtctgggacagagttcactctcaccatcagcagtctgcagtctgaagattttgcaaaatattactgt

SEQ ID NO: 10415 - DNA, 108 bp, Artificial Sequence
  Synthetic construct
aatcggccctcaggggtttctaatcgcttctctggctccaagtctggcaacacggcctccctgatcatctctgggctccaggctgaggacgaggctgattattactgc

SEQ ID NO: 10416 - DNA, 108 bp, Artificial Sequence
  Synthetic construct
agtttgcaaagtggggtcccatcaaggttcagtggcagtggatctgggacagatttcactctcaccatcagcagtctgcaacctgaagattttgcgacttactactgt

SEQ ID NO: 10417 - DNA, 108 bp, Artificial Sequence
  Synthetic construct
aaacgaccctccgggatccctgagagattctctggttccagctcagggacagtggccaccttgactatcagtggggcccaggtggaggatgaaggtgactactactgt

SEQ ID NO: 10418 - DNA, 108 bp, Artificial Sequence
  Synthetic construct
ttattgcaagcaggggtcccatcaaggttcagtggaagtggatctgggacccattttactttcaccatcagtagcctgcagcctgaagacgttgcaacatattactgt

SEQ ID NO: 10419 - DNA, 108 bp, Artificial Sequence
  Synthetic construct
agtttgcaaagtggggtcccgtcaaagttcagcggcagtggatctgggacagatttcactctcaccatcaccagcctgcagcctgaagattttgcaacttattactgc

SEQ ID NO: 10420 - DNA, 108 bp, Artificial Sequence
  Synthetic construct
accagggccactggtgtcccaggcagattcagtggcggtgggtctgggacagagttcactctcaccatcagcggcctgcagcctgaagattttgcagtttattactgt

SEQ ID NO: 10421 - DNA, 108 bp, Artificial Sequence
  Synthetic construct
agcagggccactggcgttccagacaggttcagtggcagtgggtctgggacagacttcactctcaccatcggcagcctggagcccgcagattttgcaatatatttctgt

SEQ ID NO: 10422 - DNA, 108 bp, Artificial Sequence
  Synthetic construct
cagtccatcccaggggtcccctcgaggttcagtggcagtggatctgggacagatttcaccctcaccatcaatagcctggaagctgaagatgctgcaacgtattactgt

SEQ ID NO: 10423 - DNA, 108 bp, Artificial Sequence
  Synthetic construct
agtttgcaaagtggggtcccatcaaggtttagcggcagtggatctgggacagatttcactctcaccatcagcagcctgcagcctgaagattttgcaacttactattgt

SEQ ID NO: 10424 - DNA, 108 bp, Artificial Sequence
  Synthetic construct
actttgcaaagtggggtcccttcaaggttcagtggcagtggatctgggacagatttcactctcaccatcagcagtctgcaacctgaagattctgcaacctactactgt

SEQ ID NO: 10425 - DNA, 108 bp, Artificial Sequence
  Synthetic construct
accagggccactggcgtcccagacaggttcagtggcagtgggtctgggacagacttcactctcagcatcagaggagtgcagcctgaggattctgcagtgtattactgt

SEQ ID NO: 10426 - DNA, 108 bp, Artificial Sequence
  Synthetic construct
acccgggaatccggggtccctgaacgattcagtggcagcgggtctgggacagatttcactctcaccatcagcagcctgcaggctgaagatgtggcagtttattactgt

SEQ ID NO: 10427 - DNA, 108 bp, Artificial Sequence
  Synthetic construct
aagcggccctcaggggtttctaatcgcttctctggctccaagtctggcaacacggcctccctgacaatctctgggctccaggctgaggacgaggctgattattactgc

SEQ ID NO: 10428 - DNA, 108 bp, Artificial Sequence
  Synthetic construct
agtttgcaaagtggggtcccatcaaggttcagcggcagtggatctgggacagaattcactctcacaatcagcagcctgcagcctgaagattttgcaacttattactgt

SEQ ID NO: 10429 - DNA, 108 bp, Artificial Sequence
  Synthetic construct
cggcggccctcagggatcccagagcgattctctggctccaattctgggaaagcggcctctctgaccatcagcgggacccaggctatggatgaggctgactattactgt

SEQ ID NO: 10430 - DNA, 108 bp, Artificial Sequence
  Synthetic construct
aaccggccctcagggatcccagaccgcttctctggctccaactcaggagacacagcttccttgaccatcactggggctcaggcggaagatgaggccgactattactgt

SEQ ID NO: 10431 - DNA, 108 bp, Artificial Sequence
  Synthetic construct
aatttggaaacaggggtcccatcaaggttcagtggaagtggatctgggacagattttactttcaccatcagcgtcctgcagcctgaagatattgcaacatatttctgt

SEQ ID NO: 10432 - DNA, 108 bp, Artificial Sequence
  Synthetic construct
agtttgcaaagtggggtcccatcaaagttcagcggcaatggatctgggtcagatttcactctcaccatcagcagcctgcagcctgaagattttgcaacttattactgc

SEQ ID NO: 10433 - DNA, 107 bp, Artificial Sequence
  Synthetic construct
acccggttctctggagtgccagataggttcagtggcagcgggtcagggacagatttcacactgaaaatcagccgggtggaggctgaggatgttggaattattattgc

SEQ ID NO: 10434 - DNA, 90 bp, Artificial Sequence
  Synthetic construct
cctgaccgattctctgcctccaagtctgactcgtcagccaccctggacatagccggactccagactggcgacgaggccgactactactgc

SEQ ID NO: 10435 - DNA, 95 bp, Artificial Sequence
  Synthetic construct
ggatttctaatcgcttctctggctccaagtctggcaacacggcctccctgatcatctctggcctccaggttgacgacgaggctgattattactgc

SEQ ID NO: 10436 - DNA, 108 bp, Artificial Sequence
  Synthetic construct
aaccgaccctcaggggtttctagtcgcttctctggctccaagtctggcaacacggcctccctgaccatctctgggctccaggctgaggacgaggctacttattactgc

SEQ ID NO: 10437 - DNA, 108 bp, Artificial Sequence
  Synthetic construct
agcagggccactggcatcccagacaggttcagtggcagtgggtctgggacagacttcactctcaccatcagcagaccggagcctgaagattttgcagtgtattactgt

SEQ ID NO: 10438 - DNA, 108 bp, Artificial Sequence
  Synthetic construct
agtttagaaggtggtgtcccatcaaggttcagcggcagtggatctgggacagaattcactctcaccatcagccgcctgcagcctgatgatttttcaacttattactgc

SEQ ID NO: 10439 - DNA, 108 bp, Artificial Sequence; identical to SEQ ID NO: 1855
  Synthetic construct

SEQ ID NO: 10440 - DNA, 108 bp, Artificial Sequence
  Synthetic construct
ggcagggccactggcatcccagacaggttcagtggcagtgggtctgggacagacttcactctcaccatcagcagactggagcctgaagattttgcagtgtattactgt

SEQ ID NO: 10441 - DNA, 108 bp, Artificial Sequence
  Synthetic construct
acccgggaatccggggtccctgaccgattcagtggcagcgggtctgggacagatttctctctcaccatcagcagcctgcaggctgaagatgtggcagtttattactgt

SEQ ID NO: 10442 - DNA, 108 bp, Artificial Sequence
  Synthetic construct
actcgctcttctggggtccctgatcgcttttctggctccatccttgggaacaaagctgccctcaccatcacgggggcccaggcagatgatgaatctgattattactgt

SEQ ID NO: 10443 - DNA, 108 bp, Artificial Sequence
  Synthetic construct
aagcgggactctggggtcccagacagattcagcggcagtgggtcaggcactgatttctcactgaagatcagcagggtggaggctgaggatattgggtcttattactgc

SEQ ID NO: 10444 - DNA, 108 bp, Artificial Sequence
  Synthetic construct
actcgctcttctggggtccctgatcgcttctctggctccatccttgggaacaaagctgccctcaccatcacgggggcccaggcagatgatgaatctgattattactgt

SEQ ID NO: 10445 - DNA, 108 bp, Artificial Sequence
  Synthetic construct
aatcgggcctccggggtccctgacaggttcagtggcagtggatcaggcacagattttacactgaaaatcagcagagtggaggctgaggatgttggggtttattactgc

SEQ ID NO: 10446 - DNA, 108 bp, Artificial Sequence
  Synthetic construct
aatttggaaacaggggtcccatcaaggttcagtggaagtggatctgggacagattttactttcaccatcagcagcctgcagcctgaagatattgcaacatattactgt

SEQ ID NO: 10447 - DNA, 108 bp, Artificial Sequence
  Synthetic construct
actttgcaaagtggggtcccatcaaggttcagtggcagtggatctgggacagatttcactctcactatcagcagtctgcaacctgaagactttgcaacttactactgt

SEQ ID NO: 10448 - DNA, 108 bp, Artificial Sequence
  Synthetic construct
aacagggccactggcatcccagccaggttcagtggcagtgggtctgggacagacttcactctcagcatcagcagcctagagcctgaagattttgcagtttattactgt

SEQ ID NO: 10449 - DNA, 108 bp, Artificial Sequence
  Synthetic construct
agtttgcaaagtggggccccatcaaggttcagtggcagtggatctgggacagatttcactctcaccatcagcagtctgcaacctgaagattttacaacttactactgt

SEQ ID NO: 10450 - DNA, 108 bp, Artificial Sequence
  Synthetic construct
aaccgtgacgctggtgtcccagacagattcagcggcagtgagtcaggcactgatttcatactaaaaatcagtagtgtggaggctgaggatcttggcatttattactgc

SEQ ID NO: 10451 - DNA, 108 bp, Artificial Sequence
  Synthetic construct
gaccggccctcagggatccctgagcgattctctggctccaactctgggaacacggccaccctgacaatcaccagggtcgaagccggagatgaggccgaatatttctgt

SEQ ID NO: 10452 - DNA, 114 bp, Artificial Sequence
  Synthetic construct
caaagaccctctggggtcccggctcggttctctggctccatcgacagctcctccaattctgcctccctcaccatctctggactgcagactgaggacgagggtgactactattgt

SEQ ID NO: 10453 - DNA, 108 bp, Artificial Sequence
  Synthetic construct
actttggaaagtggggtcccatcaaggttcagtggcgctggatctgggacagaattcactctcaccatcagcaacctgcagccggatgactttgcgatttattactgc

SEQ ID NO: 10454 - DNA, 108 bp, Artificial Sequence
  Synthetic construct
atcagggccactggcgtcccagccaggttcagtggcagtgggtctgggacagacttcactctcaccatcagtggcctgcagtctgaagattttgcaacgtattattgt

SEQ ID NO: 10455 - DNA, 108 bp, Artificial Sequence
  Synthetic construct
acccgggaatccggagtccctgaccgaatcagtggcagcgggtctgggacagatttcactctcaccatcagcagcctgcaggctgaagatgtggcagtttattactgt

SEQ ID NO: 10456 - DNA, 108 bp, Artificial Sequence
  Synthetic construct
gagcggccctcagggatccctgagcgattctccggctccaaatcaaggaacacggccaccctgatcatcaactgggtcgaggccggggatgaggccgactattcctgt

SEQ ID NO: 10457 - DNA, 108 bp, Artificial Sequence
  Synthetic construct
agtcttctaagtgaggtcccatcgaggttcagtggcagtggatctgggacagatttcgctctcaccatcagcagtctgcaacctgaagactttgcaacttactactgt

SEQ ID NO: 10458 - DNA, 114 bp, Artificial Sequence
  Synthetic construct
caaagaccctctggggtccctgatcggttctctggctccatcgacagctcctccaactctgcctcccttcacatctctggactgaagactgaggacgaggctgactactactgt

SEQ ID NO: 10459 - DNA, 105 bp, Artificial Sequence
  Synthetic construct
tctggagttcccagccgcttctctggatccaacgatgcatcagccaatgcagggattctgcgtatccctgggctccagcctgaggatgaggctgactattactgt

SEQ ID NO: 10460 - DNA, 108 bp, Artificial Sequence
  Synthetic construct
cagcggccctcaggggtccctgaccgattctctggctccaagtctggcacctcagcctccctggccatcagtgggctccaggccgaggatgaggctgattattcctgt

SEQ ID NO: 10461 - DNA, 108 bp, Artificial Sequence
  Synthetic construct
actttacaaagtggggtcccatcaaggttcagtggcagtggatctgggacaactttcactctctccatcagctgcctgcagtctgaagattttgcaacttattactgt

SEQ ID NO: 10462 - DNA, 108 bp, Artificial Sequence
  Synthetic construct
aggcgaccctcagggattcctgaccgattctctggctccaagtctggcacgtcagccaccctgggcatcaccggactccagactggggacgaggccgattatttctgc

SEQ ID NO: 10463 - DNA, 108 bp, Artificial Sequence
  Synthetic construct
attttacatagtggggtcccgtcaaggttcagcggcagtgggtctgggacagatttcactctcaccatcagcagcctgcagcctgaagattttgcaacttactattgt

SEQ ID NO: 10464 - DNA, 108 bp, Artificial Sequence
  Synthetic construct
acccgggaatccggggtccctgaccgattcagtggcagcgggtctgggacagacttcactctcaccatcagcagtctgcaggctgaagatgtggcagtttatttctgt

SEQ ID NO: 10465 - DNA, 114 bp, Artificial Sequence
  Synthetic construct
caaagaccctctggggtacctgatcgcttctttggctccatcgacaagtcctccaactctgcctccctcaccatatctgggctcgagactgacgacgaggctgactacttctgt

SEQ ID NO: 10466 - DNA, 108 bp, Artificial Sequence
  Synthetic construct
ttccggccctccgggatccctgagcgagtctctggctccaactctagggacacggccaccctgaccctcaacagagtcgaggccggggatgaggccgactattattgt

SEQ ID NO: 10467 - DNA, 108 bp, Artificial Sequence
  Synthetic construct
aagcggccctcaggggtccctgatcgcttctctggctccaagtctggctacacggcctccctgaccatctctgggctccgggctgacgatgaggctgattattactgc

SEQ ID NO: 10468 - DNA, 108 bp, Artificial Sequence
  Synthetic construct
tatttagaaggtggggtcccatcaaggttcagcggcagtggatctgggacagaattctctctcaccatcagcagactgcagcctgatgatcttgcaacttattactgc

SEQ ID NO: 10469 - DNA, 108 bp, Artificial Sequence
  Synthetic construct
aatttagaaggtggggtcccatcaaggttcagcggcagtggatctgggacagaattctctctcaccatcagcagactgcagcctgatgatcttgcaacttattactgc

SEQ ID NO: 10470 - DNA, 108 bp, Artificial Sequence
  Synthetic construct
aatttacaaagtggggtcccaccaaggttcagcggcagtggatttgggacagaattcactctcgccatcagcagcctgcagcctgatgattttgcaacttatttctgc

SEQ ID NO: 10471 - DNA, 108 bp, Artificial Sequence
  Synthetic construct
agtttacagagtggagtcccatcaaggttcagcggcagtggatctgagacagaattcactctcaccatcagcagcctgcagcctgatgattttggaacttattactgc

SEQ ID NO: 10472 - DNA, 108 bp, Artificial Sequence
  Synthetic construct
aagcgggactctggggtcccagacagattcagcggcagtgggtccggcactaatttcacactgaagatcagcagggtggaggctgaggatgttggggattattactgc

SEQ ID NO: 10473 - DNA, 29 bp, Artificial Sequence
  Synthetic construct
aggctgacgacgaggctgattattactgc

SEQ ID NO: 10474 - DNA, 108 bp, Artificial Sequence
  Synthetic construct
agtatagaaagtggggtcccatcaaggttcagcggcagtggatctgggacagaattcactctcaccatcaccagcctgcaccctgatgattttgcaacttattactgc

SEQ ID NO: 10475 - DNA, 108 bp, Artificial Sequence
  Synthetic construct
actttgcaaaggggggtcccatcaagatttagcgccagtgcatctggggaggacttcactctcacaatcaacagcctgcagcctgaagattttgcaacttattactgt

SEQ ID NO: 10476 - DNA, 108 bp, Artificial Sequence
  Synthetic construct
gagaggccctcacggattcctgaacgattctctggctccagctcagggacaacagccacgttgaccatcattacagtccaggcagaagacgaggctgactattactgt

SEQ ID NO: 10477 - DNA, 108 bp, Artificial Sequence
  Synthetic construct
catcggccctcaggggtctctgaccgattctctggctccaagtctggcacttcagcctccctggccatcactgggctccagcctcaggatgacggttattattattgt

SEQ ID NO: 10478 - DNA, 108 bp, Artificial Sequence
  Synthetic construct
aacagggccactggcatcccagccaggttcagtggcagtgggtctgggacagacttcactctcaccatcagcagcctagagcctgaagattgtgcagtttattactgt

SEQ ID NO: 10479 - DNA, 108 bp, Artificial Sequence
  Synthetic construct
aatttgcaaagtgcgctcccatcaaggttcagtggcagtggatctgggacagatttcactctcaccatcagcagtctgcaacctgaggattttgcagcctacttttgt

SEQ ID NO: 10480 - DNA, 69 bp, Artificial Sequence
  Synthetic construct
aagtctggcaacccggcctccctgaccatctctgggctccaggctgacgacgaggctgattattactgc

SEQ ID NO: 10481 - DNA, 108 bp, Artificial Sequence
  Synthetic construct
aatcggccctcagggatttctaatcgcttctctggctccaagtctggcaacacggcctccctgaccatctctgggctccaggctgacgacgaggctgattattacttc

SEQ ID NO: 10482 - DNA, 108 bp, Artificial Sequence
  Synthetic construct
atcagggccactggcatcccagccaggttcagtggcagtgggtctgggacagacttcactctcaccatcagcagcctagagcctgaagattttgcagtttattactgt

SEQ ID NO: 10483 - DNA, 108 bp, Artificial Sequence
  Synthetic construct
actttgcaaagtggggtcccatcaaggttcagcggcagtggatttgagacagatttcactctcaccataaccagcctgcagcctgaagattttgcaacttattactgc

SEQ ID NO: 10484 - DNA, 108 bp, Artificial Sequence
  Synthetic construct
aaccggttctctggggtcccagacagattcagtggcagtggggctgggacagatttcacactgaaaatcagcagggtggaagctgaggatgtcggggtttattactgc

SEQ ID NO: 10485 - DNA, 108 bp, Artificial Sequence
  Synthetic construct
aatcggccctcaggggtttctaatcgcttctctggctccaagtctggcaacacggcctccctgaccatctctgggctccaggctgaggacgagggtgattattactgc

SEQ ID NO: 10486 - DNA, 108 bp, Artificial Sequence
  Synthetic construct
gccagggccactggtgtcccagccaggttcagtggcagtgggtctgacacagagttcactctcaccatcagcagcctgcagtctgaagattttgcagtttattactgt

SEQ ID NO: 10487 - DNA, 108 bp, Artificial Sequence
  Synthetic construct
aagagggccactggcgtcccagccaggttcagtggcagtgggtctgggacagacttcactctcaccatcagcagcctagaggctgaagattttgcggtttattattgt

SEQ ID NO: 10488 - DNA, 108 bp, Artificial Sequence
  Synthetic construct
gagcgaccctcagggattcctgaccgattctctggctccaagtctggcacgtcagccaccctgggcatcaccggactccagactggggacgaggccgattattactgc

SEQ ID NO: 10489 - DNA, 108 bp, Artificial Sequence
  Synthetic construct
aagcggccctcaggggtttctaatcgcttctctggctccaagtctggcaacacggcctccctgacaatctctgggctccaggctgacgacgaggctgattattactgc

SEQ ID NO: 10490 - DNA, 108 bp, Artificial Sequence
  Synthetic construct
agtttgcaaagtggggtcccatcaaggttcagcggcagtggatctgggacagatttcactctcaccatcagcagcctgcaacctgaagattttgcaacttactattgt

SEQ ID NO: 10491 - DNA, 108 bp, Artificial Sequence
  Synthetic construct
gaccggccctccgggatccctgagcgattctctggctccaactctgggaacacggccaccctgaccatcagcagggtcgaagccggggatgaggccgactattactgt

SEQ ID NO: 10492 - DNA, 108 bp, Artificial Sequence
  Synthetic construct
aacagggccactggcatcccagccaggttcagtggcagtgggtctgggacagacttcactctcaccatcagcagcctagagcctgaagattctgcagtttattactgt

SEQ ID NO: 10493 - DNA, 108 bp, Artificial Sequence
  Synthetic construct
actttgcaatatggggtcccatcaaggttcagcggcagtggatctgggacagacttcactctcacaatcagcagcctgcagcctgaagattttgcaacttattactgt

SEQ ID NO: 10494 - DNA, 108 bp, Artificial Sequence
  Synthetic construct
atcagggccgctggtgtcccaaccaggttcagtgccagtgggtctgagacggacttcactctcaccatcagcagtgtgcaatctgaagattttgcagattattactgt

SEQ ID NO: 10495 - DNA, 114 bp, Artificial Sequence
  Synthetic construct
caaagaccctctggggtccctgatcggttctctggctccatcgacagctcctccaactctgcctccctcaccatctctggactgaggcctgacgacgaggctgactactactgt

SEQ ID NO: 10496 - DNA, 108 bp, Artificial Sequence
  Synthetic construct
actttgcaaactggggtcccatcaaggttcattggcagtggatctgggacagatttcactctcaccatcacctccctgcagtctgaagattttgcatcctattactgt

SEQ ID NO: 10497 - DNA, 108 bp, Artificial Sequence
  Synthetic construct
aggcgaccctcagggattcctgaccgattctctggttccaagtctggcacgtcagccaccctggacatcaccggactccagactggggacgaggccgattattactgc

SEQ ID NO: 10498 - DNA, 108 bp, Artificial Sequence
  Synthetic construct
actttgcaaagaggggtcccatcaaggttcagtggcagtggatctgggacagaattcactctcaccatcagttgcctgcagtctgaggattttgcaacttactactgt

SEQ ID NO: 10499 - DNA, 108 bp, Artificial Sequence
  Synthetic construct
aagcggccttcagggatccctgagcgattctctggctccaactctgggaacacagccactctgaccatcagcgggacccaggctatggatgaggctgcctattactgt

SEQ ID NO: 10500 - DNA, 108 bp, Artificial Sequence
  Synthetic construct
actttgcacagtggggtcccttccaggttcagtggcagtggatctgggacagatttcactctcaccatcagcagtctgcaacctgaagattttgcaacttactactgt

SEQ ID NO: 10501 - DNA, 108 bp, Artificial Sequence
  Synthetic construct
aagcggccctctggggtttctaatcgcttctctggctccaagtctggcaacacggcctccctgacaatctctgggctccaggctgaagacgaggctgattattactgc

SEQ ID NO: 10502 - DNA, 108 bp, Artificial Sequence
  Synthetic construct
aagcggccctctggggtttctaatcgcttctctggctccaagtctggcaacacggcctccctgacaatctctgggctccaggctgaggacgaggttgattattactgc

SEQ ID NO: 10503 - DNA, 96 bp, Artificial Sequence
  Synthetic construct
ggggtttctaatcgcttctctggctccaagtctggcaacacggcctccctgacaatctctgggctccaggctgaagacgaggctgattattactgc

SEQ ID NO: 10504 - DNA, 108 bp, Artificial Sequence
  Synthetic construct
aatcggccctcagggatttctaatcgcttctctggctccaagtctggcaacacggcctccctgacaatctctgggctccaggctgacgacgaggctgattattactgc

SEQ ID NO: 10505 - DNA, 108 bp, Artificial Sequence
  Synthetic construct
aaccgaccctcagggattcctgaccgattctctggctccaagtctggcacgtcagccaccctgggcatcaccggactccagactggggacgaggccgattattactgc

SEQ ID NO: 10506 - DNA, 108 bp, Artificial Sequence
  Synthetic construct
aagcggccctcaggggtttctaatcgcttctctggctccaagtctggcacgtcagccaccctgggcatcaccggactccagactggggacgaggccgattattactgc

SEQ ID NO: 10507 - DNA, 108 bp, Artificial Sequence
  Synthetic construct
gatcggccctcaggggtctctaatcgcttctctggctccaagtctggcaacacggcctccctgactatctctgggctccaggctgaggacgaggctgattattactgc

SEQ ID NO: 10508 - DNA, 108 bp, Artificial Sequence
  Synthetic construct
aagcggccctcagggatccctgagcgattctctggctccaactctggggacacagccactctgaccatcaccgggacccagccgacggatgaggctgtctattactgt

SEQ ID NO: 10509 - DNA, 108 bp, Artificial Sequence
  Synthetic construct
aatcgggactctggggtcccagacagattcagcggcagtgggtcaggcactgacttcacactggaaatcagcagcgtggaggctgaggatgttggggtttattactgc

SEQ ID NO: 10510 - DNA, 108 bp, Artificial Sequence
  Synthetic construct
acccgggaatccggggtccctgaccgattcagtggcagcgggtctgggacagatttcactctcaccatcagcagcctgcaggctgacgatgtggcagtttattactgt

SEQ ID NO: 10511 - DNA, 108 bp, Artificial Sequence
  Synthetic construct
agcagggccactggcaccccagacaggttcagtggcagtgggtctgggacagagttcactctcaccatcagcagcctgcagtctgaagattttgcagtttattactgt

SEQ ID NO: 10512 - DNA, 108 bp, Artificial Sequence
  Synthetic construct
cttcgcacttctggggtccctgatcgcttctctggctccattattgggaacaaagctgccctcaccatcacgggggcccaggcagatgatgactgtgactattactgt

SEQ ID NO: 10513 - DNA, 108 bp, Artificial Sequence
  Synthetic construct
gatttacaacctggggtcccatcaaggttcagcggcagtgggtctgggacagaattcactctcaccatcaccagcctgcagcctgatgattttggtacttatcactgc

SEQ ID NO: 10514 - DNA, 108 bp, Artificial Sequence
  Synthetic construct
actttgcaatcaggggtcccatctcggttcagtggcagtggatctgggacagatttcactctcaccatcagcagcctgcagcctgaagatgttgcaacttattactgt

SEQ ID NO: 10515 - DNA, 108 bp, Artificial Sequence
  Synthetic construct
tacaaatactcctggacacctgcccgcttctcaggctccctccttgggggcaaagctgccctgaccctttcgggtgcgctgcctgaggatgaggctgactattactgc

SEQ ID NO: 10516 - DNA, 108 bp, Artificial Sequence
  Synthetic construct
acccgggaatccggggtccctgaccgattcagtggcagcgggtctgggacagacttcactctcaccatcagcagtgtgcaggctgaagatgtggcaatttattactgt

SEQ ID NO: 10517 - DNA, 108 bp, Artificial Sequence
  Synthetic construct
aaccggttctctggagtgccagataggttcagtggcagcgggtcagggacagatttcacactgaaaatcagccgggtggaggctgaggatgttggagtttattactgc

SEQ ID NO: 10518 - DNA, 108 bp, Artificial Sequence
  Synthetic construct
agtttgcaaagtggggtcccatcgaggttcagtggcagtggatctgggacagatttcactctcaccatcagcagtctgcaacctgaagattttgcaacttactactgt

SEQ ID NO: 10519 - DNA, 108 bp, Artificial Sequence
  Synthetic construct
agtttgcaaaatggggtcccatcaaggttcagcggcagtggctctgggacagatttcactctcaccatcagcagcctgcagcctgaagattttgcaacttacttttgt

SEQ ID NO: 10520 - DNA, 108 bp, Artificial Sequence
  Synthetic construct
aagcggccctcaggggtccctgatcgcttctctggctccaagtctggcaacacggcctccctgaccgtctctgggctccaggctgaagatgaggctgattattactgc

SEQ ID NO: 10521 - DNA, 108 bp, Artificial Sequence
  Synthetic construct
actcggcccactgggatcccagccaagttcaggggcagtgggtctgggacagaattcactctcaccatcgtcagcctccagtctgaagattttgcagtttattactgt

SEQ ID NO: 10522 - DNA, 108 bp, Artificial Sequence
  Synthetic construct
aatcggccctcaggagttgctcatcggttctctggctccaagtctggcaacacggcctccctgaccatctctgggctccaggctgaggacgaggctgattattactgc

SEQ ID NO: 10523 - DNA, 108 bp, Artificial Sequence
  Synthetic construct
actttaaatagtggggtcccgtcgaggttcagcggcagtggatctgggacagacttcaccctcaccatcagcagcctgcagcctgatgattttgcaacttattactgc

SEQ ID NO: 10524 - DNA, 108 bp, Artificial Sequence
  Synthetic construct
aaccggccctcagggatcccagaccgattctctggctccacctcaggaaacacagcttccttgaccatcactggggctcaggcggaagatgaggctgactattactgt

SEQ ID NO: 10525 - DNA, 108 bp, Artificial Sequence
  Synthetic construct
cagcggccctcaggggtccctgaccgattctctggctccaagtctggcacctcagcctccctggccatcagtgggctccaggctgaggatgaggctgattattactgt

SEQ ID NO: 10526 - DNA, 108 bp, Artificial Sequence
  Synthetic construct
aatcgaccctcgggggtttctaatcgcttctctggctccaagtctggcaacacggcctccctgaccatctctgggctccaggctgaggacgagggtgactattactgc

SEQ ID NO: 10527 - DNA, 108 bp, Artificial Sequence
  Synthetic construct
agcaggaccactggcatcccagacaggttcagtggtggtgggtctgggacagacttcactctcaccatcagcagactggagcctgaagattttgcagtgttttactgt

SEQ ID NO: 10528 - DNA, 108 bp, Artificial Sequence
  Synthetic construct
caattgcaaaggggggtcccatcaaggttcagcggctggggatatgggaaaaatttcactctcaccgtcagcagcctgcagcctgaagattttgcaatttattactgt

SEQ ID NO: 10529 - DNA, 108 bp, Artificial Sequence
  Synthetic construct
gaccggccctcagggatccctgagcgattctctggctccaactctgagaacacggccaccctgaccatcagcagggtcgaagccggggatgaggccgactatttctgt

SEQ ID NO: 10530 - DNA, 108 bp, Artificial Sequence
  Synthetic construct
accagggccactggtatcccagccaggttcagtggcagtgggtctgggacagaattcactctcaccatcagcagcctgcagtctgaagattttgcagtttattactgt

SEQ ID NO: 10531 - DNA, 108 bp, Artificial Sequence
  Synthetic construct
accagggccactggtgtcccagccaggttcagtggcagtgggtctgggacagagttcactctcaccatctacagcctccagtctgaagactttgcagtctactactgt

SEQ ID NO: 10532 - DNA, 108 bp, Artificial Sequence
  Synthetic construct
aagcggccctcaggtgtttctaatcgcttctctggctccaagtccggcaacacggcctccctgacaatctctggactccaggctgaggacgaggctgattattattgc

SEQ ID NO: 10533 - DNA, 108 bp, Artificial Sequence
  Synthetic construct
aagcggccctcaggggtttctaatcgcttctctggctccaagtccggcaacacggcctccctgacaatctctggactccaggctgaggacgaggctgattattattgc

SEQ ID NO: 10534 - DNA, 108 bp, Artificial Sequence
  Synthetic construct
acccgggaatccggggtccctgaccgattcactggcagcgggtctgggacagaattcactctcaccataagcagcctgcaggctgaagatgtggcagtttattactgt

SEQ ID NO: 10535 - DNA, 108 bp, Artificial Sequence
  Synthetic construct
gtccggccctcagggatccctgagcgattctccggctccctgtcctcggacacggccaccctgaccatcagcaggatcgaggccggggatgaggccgactattattgt

SEQ ID NO: 10536 - DNA, 108 bp, Artificial Sequence
  Synthetic construct
accagggccactggcacccccgcccgattcattggcagtgggtctgggacagacttcactctcaccatcagcgacctgcagtctgaagactttggtgtttattactgt

SEQ ID NO: 10537 - DNA, 108 bp, Artificial Sequence
  Synthetic construct
accagggccactggtttcccagccaggttcagtggcagtgggtctgggacagagttcactctcaccatcagcagccttcagtctgaagactttgcagtttattattgt

SEQ ID NO: 10538 - DNA, 108 bp, Artificial Sequence
  Synthetic construct
aacagggcctcgggcatcccagccaggttcagtggcagtgggtctgggacagacttcagtctcaccatcagcagcctagagcctgaagattgtgcagtttattactgt

SEQ ID NO: 10539 - DNA, 108 bp, Artificial Sequence
  Synthetic construct
accagggccaccggtatcccagccaggttcagtggcagtgggtctgggacagagttcactctcaccatcagcagcctgcagtctgacgattttgcagtttattactgt

SEQ ID NO: 10540 - DNA, 108 bp, Artificial Sequence
  Synthetic construct
agtttgcaaagtggggtcccatcaaggttcagtggcagtggatctgggacagatttcactctcaccatcagcagtctgcaacctgaggattttgcaacttactcctgt

SEQ ID NO: 10541 - DNA, 108 bp, Artificial Sequence
  Synthetic construct
aagcgaccctcagggattcctgaccgattctctggctccaagtctggcacgtcagccaccctgcacatcaccggactccagactggggacgaggccgattattactgc

SEQ ID NO: 10542 - DNA, 108 bp, Artificial Sequence; identical to SEQ ID NO: 1854
  Synthetic construct

SEQ ID NO: 10543 - DNA, 108 bp, Artificial Sequence
  Synthetic construct
actttgcagagtggggtcccatcaaagttcagcggcagtggctctgggaccgatttcactctcaccatctccggcctgcagcctgatgattctgcaacttattactgc

SEQ ID NO: 10544 - DNA, 108 bp, Artificial Sequence
  Synthetic construct
actcgaaaatccggggtccctgagcgattcgctgccggcgggtctgacacaaggttctctctcaccatcgcccctgtccagagtgaagacgtggcgacttattactgt

SEQ ID NO: 10545 - DNA, 108 bp, Artificial Sequence
  Synthetic construct
aatttaaaaagtggggtcccatcaaggttcagcggcagtggatctgggacagagttcactctcaccatcagcagcctgcagcctgatgattttgcaacttattactgc

SEQ ID NO: 10546 - DNA, 108 bp, Artificial Sequence
  Synthetic construct
gagcggccctcagggatccctgagcgattctctggctccaactctgggcacacagccactctgaccatcagcgggacccaggctgtggatgaggctgagtattactgt

SEQ ID NO: 10547 - DNA, 108 bp, Artificial Sequence
  Synthetic construct
atcagggccactggcgtctcagacagattcagtggcagggggtctgggacagacttcactctcaccatcagccacgtagagcctgaagattttgcactttattattgt

SEQ ID NO: 10548 - DNA, 108 bp, Artificial Sequence
  Synthetic construct
aacagggccactggcatcccagccaggttcagtggcagtgggtctgggacagacttcactctcaccatcagtagcctggagcctgaagattttgcagtttattactgt

SEQ ID NO: 10549 - DNA, 108 bp, Artificial Sequence
  Synthetic construct
aatcgggactctggggtccctgacagattaagcggcagtggatcaggcactgattttacattgaaaatcagcagggtggaggctaacgataccggaatgtatttttgt

SEQ ID NO: 10550 - DNA, 108 bp, Artificial Sequence
  Synthetic construct
agtttgcaaagtggggtcccattaaggttcagtggcagtgggtctgggacagatttcactctcaccatcagcaatctgcaacctgaagattttgcaacttactactgt

SEQ ID NO: 10551 - DNA, 108 bp, Artificial Sequence
  Synthetic construct
cagcgaccctcaggggtccctgaccgattctctggctcccagtctggcacctcagcctccctggccatcagtgggctccagtctgaggatgagggtttttatttctgt

SEQ ID NO: 10552 - DNA, 108 bp, Artificial Sequence
  Synthetic construct
aaccggccctcagggatctcagagagattatctgcatccaggtcaggaaacacagcctccctgaccattactggactccagcctgaggacgaggctgactattactgc

SEQ ID NO: 10553 - DNA, 108 bp, Artificial Sequence
  Synthetic construct
agtttagagagtggggtcccatcaaggttcagcggcagtggatctgggacagaattcactctcaccatcagcagcctgcagcctgatgattttgcaacttattactgt

SEQ ID NO: 10554 - DNA, 108 bp, Artificial Sequence
  Synthetic construct
gatcggccctcagggatttctgatcgcttctctggctccaggtctggcaacacggcctccctgtccatctctgggctccaggctgttgacgaggctgattactactgc

SEQ ID NO: 10555 - DNA, 108 bp, Artificial Sequence
  Synthetic construct
actagggccactggtgtcccagccaggatcagtggcagtgggtctgggacagagttcactctcaccatcagcagcctgcagtctgaagattttggagtttattactgt

SEQ ID NO: 10556 - DNA, 108 bp, Artificial Sequence
  Synthetic construct
aatcgggcctccggggtccctgacaggttcagtggcaggggatcaggcacagattttatactgacaatcagtagagtggaggctgaggatgttggggtgtacttctgc

SEQ ID NO: 10557 - DNA, 108 bp, Artificial Sequence
  Synthetic construct
accttgcaaagtggggtcccatcaaggttcagcggcagtggatctgggacagattttactctcaccatcaacagcctgcagcctgaagattttgcaacttactattgt

SEQ ID NO: 10558 - DNA, 108 bp, Artificial Sequence; identical to SEQ ID NO: 1857
  Synthetic construct

SEQ ID NO: 10559 - DNA, 108 bp, Artificial Sequence
  Synthetic construct
agtttgcaaagtggggtcccatcaaggttcagcggcagtggatctgggacagaattcactctcacaatcagcagcctgcagcctgaagattttgcaagttattactgt

SEQ ID NO: 10560 - DNA, 108 bp, Artificial Sequence
  Synthetic construct
actttgcagaccggagtcccacctagattcaatggcagtggatctgggacagatttcactctcaccatcagctgcctgcagtctgaagaccttggaacctattactgt

SEQ ID NO: 10561 - DNA, 108 bp, Artificial Sequence
  Synthetic construct
acccgggagtccggggtccctgaccgattcagtggcagcgggtctgggacagatttcactctcaccatcagcagcctgcaggctgaagatgtggccgtttattactgt

SEQ ID NO: 10562 - DNA, 108 bp, Artificial Sequence
  Synthetic construct
aagcggccctcagggatccctgatcgcttctctggctcccagtctggcaacacggcctccctgaccgtctctgggctccaggctgaggatgaggctcattatttctgc

SEQ ID NO: 10563 - DNA, 108 bp, Artificial Sequence
  Synthetic construct
acccgggaatccggggtcccagaccgattcattggcagcgggtctgggacagatttcactctcaccatcagcaccctgcaggctgaagatgtggcggtttatttctgt

SEQ ID NO: 10564 - DNA, 108 bp, Artificial Sequence
  Synthetic construct
actttagaaagtggggtcccatcaagattcagcggcagtggatctgggacagacttcactctcaccatcagcagcctgcagcctgatgattttgcaacttattactgc

SEQ ID NO: 10565 - DNA, 108 bp, Artificial Sequence
  Synthetic construct
agtttacaaagtgacgtcccgccaaggttcagcggcagtggatctgggacagaattcactctcaccatcagcagcctgcagcctgatgattttgcaacttattactgc

SEQ ID NO: 10566 - DNA, 108 bp, Artificial Sequence
  Synthetic construct
actttgcaaagtggggtcccatcaaggttcagtggcagtggatctgggacagatttcactctcaccatcagtagtctgcaacctgaagattttgcaacttactactgt

SEQ ID NO: 10567 - DNA, 108 bp, Artificial Sequence
  Synthetic construct
aatcggccctcagggatccctgagcgattctctggctccaactctggaaacacggccaccctgagcatcagtggggtcgaagccggggatgaggccgactacttctgt

SEQ ID NO: 10568 - DNA, 108 bp, Artificial Sequence
  Synthetic construct
aagcgaccctcaggacttcctgaccgattctctggcgccaagtctggcacgtcagccaccctggccatcaccggactccagactggggacgaggccgattactactgc

SEQ ID NO: 10569 - DNA, 108 bp, Artificial Sequence
  Synthetic construct
aacagggccactggcatcccagacaggttcagtgccagtgggtctgggacagacttcactctcaccatcagcagactggaccctgaagattttgcagtgtattactgt

SEQ ID NO: 10570 - DNA, 108 bp, Artificial Sequence
  Synthetic construct
accagggccactggcatcccagacaggttcggtggcagtgggtctgggacagacttcactctcaccatcagcaaactggagcctgaagattttgcagtgtatttctgt

SEQ ID NO: 10571 - DNA, 108 bp, Artificial Sequence; identical to SEQ ID NO: 1853
  Synthetic construct

SEQ ID NO: 10572 - DNA, 108 bp, Artificial Sequence
  Synthetic construct
aaacggccctcaggggtccctgatcgcttctctggctccaagtctggcaacacggcctccctgaccatctctgacctcctggctgaagatgaggctgactactactgc

SEQ ID NO: 10573 - DNA, 108 bp, Artificial Sequence
  Synthetic construct
aatagggccgctggcgttcccgacagattcagtggcagtgggtctggagcagagttcactctcaccatcaccagactggagcctgaagattttgcagtctatttctgt

SEQ ID NO: 10574 - DNA, 108 bp, Artificial Sequence
  Synthetic construct
actttggggagtggggtcccatccaggtttagtggcagtggttctggggcggattacattctcaccatcaccaccctgcaacctgaggatttcgcttcttattactgt

SEQ ID NO: 10575 - DNA, 108 bp, Artificial Sequence
  Synthetic construct
actttgcaaagtggggtcccaacaaggttcagtggcagtggatctgggacagagttcactctcaccatcagcagtctgcaacctgaagattttgcaacttactactgt

SEQ ID NO: 10576 - DNA, 108 bp, Artificial Sequence
  Synthetic construct
gacagggccactggcatcccagccaggttcagtggcagtgggtctgggacagacttcactctcaccatcagcagcctagagcctgaagattttgcagtttattactgt

SEQ ID NO: 10577 - DNA, 108 bp, Artificial Sequence
  Synthetic construct
gtccggcccccagagatccctgagcgattctctggctccaattctgggaacacggccaccctgaccatcaacagggtcaaagccggggatgaggccgactatttttgt

SEQ ID NO: 10578 - DNA, 108 bp, Artificial Sequence
  Synthetic construct
aagcgaccctcagggattcctgaccgattctctggctccaagtctggcacgtcagccaccctggacatcaccgaaatcctgactggggaccaggccgattattactgc

SEQ ID NO: 10579 - DNA, 108 bp, Artificial Sequence
  Synthetic construct
aagcgaccctcagggattcctgaccgattctctggcgccaagtcaggcacgtcagccaccttggacatcaccggactccagactggggacgaggccgattattactgc

SEQ ID NO: 10580 - DNA, 108 bp, Artificial Sequence
  Synthetic construct
acccgggaatccggggtccctgaccgaatcagtggcaccgggtctgggacagatttcactctcaccatcagtgatctacaggctgcagatgtggcagtttattactgt

SEQ ID NO: 10581 - DNA, 108 bp, Artificial Sequence
  Synthetic construct
aagaggccctcaggactccctgaccgattctctggctccaagtctggcacctcagcctccctggccatcagtgggctccagtctgaggatgaggctgattattactgt

SEQ ID NO: 10582 - DNA, 108 bp, Artificial Sequence
  Synthetic construct
aatttggaaacaggggtcccatcaaggttcagtggacgtggctctgggacactttttacattcaccatcagtagcctgcaggctgaagatattgcaacatattactgt

SEQ ID NO: 10583 - DNA, 108 bp, Artificial Sequence
  Synthetic construct
aagcgaccctcagggatccctgatcgcttctctggctcccagtctggcaacacggcctccctgaccgtctctgggctccaggctgaggatgaggctgattatttctgc

SEQ ID NO: 10584 - DNA, 108 bp, Artificial Sequence
  Synthetic construct
agcagggccactggcatcccagacaggttcagtggcagtgggtctgggacagacttcactctcaccatcagcagactggagcctgaagattttgcagtctatttctgt

SEQ ID NO: 10585 - DNA, 108 bp, Artificial Sequence
  Synthetic construct
agcagggccactggcatccccgacaggttcagtggcagtgggtctgggacagacttcactctcaccatcagcagactggagcctgaagattctgcagtatattactgt

SEQ ID NO: 10586 - DNA, 108 bp, Artificial Sequence
  Synthetic construct
gaccggccctcagggatccctgagcgattctctggctccaactctgggaacacggccaccctgaccatcaccagggtcgaagccggggatgaggccgactattcctgt

SEQ ID NO: 10587 - DNA, 108 bp, Artificial Sequence
  Synthetic construct
aaccggttctctggggtgccagataggttcagtggcagcgggtcagggacagatttcacactgaaaatcagccgggtggaggctgaggatgttggagtttattactgc

SEQ ID NO: 10588 - DNA, 108 bp, Artificial Sequence
  Synthetic construct
agcagggccactggcatcccagacaggttcagtggcagtgggtctgggacagacttcactctcaccatcagcaggctggagcctgaagattttgcagtgtattactgt

SEQ ID NO: 10589 - DNA, 108 bp, Artificial Sequence
  Synthetic construct
accccggcatccggagtccctggccgattcaacggcagcggctccgggacagatttcactctcaccatcaccagtctgcaggctgaagatgtgggcgtctattactgt

SEQ ID NO: 10590 - DNA, 108 bp, Artificial Sequence
  Synthetic construct
actttgcagagtggggtcccatcaaggttcagtggcagtgggtctggggcagatttcactctcaccatcagcagtctgcaacctgaagattttgcgacttactactgt

SEQ ID NO: 10591 - DNA, 108 bp, Artificial Sequence
  Synthetic construct
actttgcaacgtggggtcccatcaaggttcagcgccagtggatctgggacagatttcactctctccatcagcagcctgcagcctgaagattttgcaacttattactgt

SEQ ID NO: 10592 - DNA, 108 bp, Artificial Sequence
  Synthetic construct
aaacgaccctcagggattcctgaccgattctctggctccaagtctggcacgtcagccaccctggacatcaccggactccagactggggacgaggccgactattactgc

SEQ ID NO: 10593 - DNA, 108 bp, Artificial Sequence
  Synthetic construct
aatcggccctcaggagtctctcatcgcttctctggctccaagtctggctacacggcctccctgatcatctcggggctccaggctgaggacgaggctgattatttctgc

SEQ ID NO: 10594 - DNA, 108 bp, Artificial Sequence
  Synthetic construct
aggttggaaagtggagtcccgtcaacgttcagcggcggtggatctgggacagttttcattctcttcatcagcagtatgcagcctgaagattttggaacttactattgt

SEQ ID NO: 10595 - DNA, 108 bp, Artificial Sequence
  Synthetic construct
cagcggctctcaggggtccctgaccgattctctggctccaagtctggcacctcagcctccctggccatcagtgggctccggtccgaggatgaggctgattattactgt

SEQ ID NO: 10596 - DNA, 108 bp, Artificial Sequence
  Synthetic construct
aatcggttctctggagtgccagataggttcagtggcagcgggtcagggacagatttcacactgaaaatcagccgggcggaggctgaggatgtcgggatctattactgc

SEQ ID NO: 10597 - DNA, 108 bp, Artificial Sequence
  Synthetic construct
aagcgaccctcagggattcctgaccgattctctggctccaagtctggcacgtcagccaccctgggcatcaccggactccagactggggacgaggccgcttattactgc

SEQ ID NO: 10598 - DNA, 108 bp, Artificial Sequence
  Synthetic construct
caggggccctcaggggtccctgaccgattctctggctccaagtctggcacctcagcctccctggccatcagtgggctccagtctgaggatgaggctgattattactgt

SEQ ID NO: 10599 - DNA, 108 bp, Artificial Sequence
  Synthetic construct
agcagggccactggcatcccagacaggttcagtggaagtgggtctgggacagacttcactctaatcatcaccacagtagagcccgaagattttgccgtgtattattgt

SEQ ID NO: 10600 - DNA, 108 bp, Artificial Sequence
  Synthetic construct
actctcgttcctggaatcccacctcgattcagtggcagcgggtctggaacagattttaccctcacaattgataacatagaatctgaggattctccttattacttctgc

SEQ ID NO: 10601 - DNA, 108 bp, Artificial Sequence
  Synthetic construct
agtttgcaaagtggggtcccatcaaggttcagtggcagtggatctgggacatatttcactctcaccatcaacagtctgcaacctgaagattttgcagcttactactgt

SEQ ID NO: 10602 - DNA, 108 bp, Artificial Sequence
  Synthetic construct
aaattggaaagtggggtccctcccaggttcagtggcagtggatctggggcgcagtacactctcaccatcaccagcctgcagcctgaagattttgcaacttattactgt

SEQ ID NO: 10603 - DNA, 108 bp, Artificial Sequence
  Synthetic construct
tctttacattcgggggtcccatcgagattcagcggcagtgggtctggggcagagttcactctcacaatcaacggcctacagcctgaagattttgcaacttactactgt

SEQ ID NO: 10604 - DNA, 108 bp, Artificial Sequence
  Synthetic construct
gagaggccctcagggattcctgaacgattctctggctccagctcagggacaacagtcaccttgaccatcactggagtccaggcagaagacgaggctgactattattgt

SEQ ID NO: 10605 - DNA, 108 bp, Artificial Sequence
  Synthetic construct
attttggaaacaggggtctcttcaaggttcagtggcagtggatctgggacaaatttttccttcaccatcaacaactttcagcccgaggacgtggcaacatatgtctgt

SEQ ID NO: 10606 - DNA, 108 bp, Artificial Sequence
  Synthetic construct
agtttgcaaaggggggtcccgtcaaggttcagcggcagtggatctgggacagatttcactctcaccatcagcagcctgcagcctgaagattttgcgacttactattgt

SEQ ID NO: 10607 - DNA, 108 bp, Artificial Sequence
  Synthetic construct
acccgagagtccggggtcccggaccgattcagtgccagcgggtctgggagtgatttcactttgaccatcagcagcctgcaggctgaggatgtggctgtttattattgt

SEQ ID NO: 10608 - DNA, 108 bp, Artificial Sequence
  Synthetic construct
gaccggccctcagggatccctgagcgattctctggcgccaactctgggaacacggccaccctgaccatcagcacggtcgaagccggggatgaggccgactatcactgt

SEQ ID NO: 10609 - DNA, 108 bp, Artificial Sequence
  Synthetic construct
actttgcaaagtggggtcccatcaaggttcagcggcagtggatctgggacagaattcactctcacaatcagcagcctgcagcctgaagattttgcaacttattactgt

SEQ ID NO: 10610 - DNA, 108 bp, Artificial Sequence
  Synthetic construct
aatcggccctcaggggtttcttatcgcttctctggctccaagtctggcaacacggcctccctgaccatctctggcctccaggctgaggacgaggctgattatttctgc

SEQ ID NO: 10611 - DNA, 108 bp, Artificial Sequence
  Synthetic construct
accagggccactggtatcccagccaggttcagtggtagtggatttgggacagagttcactctcaccatcttcaacgtgcagtctgaagattgtgcagtttattactgt

SEQ ID NO: 10612 - DNA, 108 bp, Artificial Sequence
  Synthetic construct
agttttcatggtggggtccctgcaaggttcactggcagtggatctgggacagatttcactctcactatcaacactctgcaacctgaagattttgcaacttactactgc

SEQ ID NO: 10613 - DNA, 108 bp, Artificial Sequence
  Synthetic construct
aacaggcccactggcatcccaggcaggttcagtgccagtgggtctgggacagacttcactctcaccatcagcagcctagagcctgaagattttgcagtttattactgt

SEQ ID NO: 10614 - DNA, 108 bp, Artificial Sequence
  Synthetic construct
aatcggccctcaggggtccctgaccgattctctggctccaagtctgccacctcagcctccctggccatcactgggctccaggctgaggatgaggctgattattactgc

SEQ ID NO: 10615 - DNA, 108 bp, Artificial Sequence
  Synthetic construct
gatcggccctcagggatttctaatcgcttctctggctccaagtctggcaacacggcctccctgaccatctctgggctccaggctgacgacgaggctgattattactgc

SEQ ID NO: 10616 - DNA, 108 bp, Artificial Sequence
  Synthetic construct
aatcggccctcagggatcccagaccgattcattggctccgcctcaggaagcacagcttacttgatcatcaataacattgaggcggacgatgaggctgactattattgt

SEQ ID NO: 10617 - DNA, 98 bp, Artificial Sequence
  Synthetic construct
gagggatcccagaccgattcattggctccgcctcaggaagcacagcttacttgatcatcaataacattgaggcggacgatgaggctgactattattgt

SEQ ID NO: 10618 - DNA, 108 bp, Artificial Sequence
  Synthetic construct
aacagggccactggcatcccagccaggttcggtggcagtgggtctgggacagacttcactctcaccatcagcagcctagagcctggagactttgcagtttattactgt

SEQ ID NO: 10619 - DNA, 108 bp, Artificial Sequence
  Synthetic construct
agtttgcagggtggggtcccatcgaggttcagcggcggtggatctgggacagaattcactctcaccatcagcagcctgcagcctgaagattccgcaatttactattgt

SEQ ID NO: 10620 - DNA, 108 bp, Artificial Sequence
  Synthetic construct
cagtccatctcaggggtcccctcgaggttcagtggcagtggatctgggacagatttcaccctcagcatcaatagcctggaagctgaagatgctgcaacgtattactgt

SEQ ID NO: 10621 - DNA, 108 bp, Artificial Sequence
  Synthetic construct
agcagggccactggcatcccagacaggttcagtggcagtgggtctgggacagacttcactctcaccatcaacagactggagcctgaagattttgcattttattactgt

SEQ ID NO: 10622 - DNA, 108 bp, Artificial Sequence
  Synthetic construct
attttgcaaaatggggtcccctcaaggttcagtggcagtgggtctgggacagatttctctctcaccatcagcagtctccaacctgaagattttgcaacttactactgt

SEQ ID NO: 10623 - DNA, 108 bp, Artificial Sequence
  Synthetic construct
ggtttagaaactggagtcccatccaggttcagcggcagtggatctgggaccgaattcactctcaccatcaacagcctgcagcctgatgattttgcaacttattactgc

SEQ ID NO: 10624 - DNA, 108 bp, Artificial Sequence
  Synthetic construct
acgagggccactggtatcccagccaggttcagtggcagtgggtctgggacagagttcactctcaccatcagcagcctgcagtctgaagattttgcagtttattactgt

SEQ ID NO: 10625 - DNA, 108 bp, Artificial Sequence
  Synthetic construct
aggagggccattgacatcccagacaggttcaggggcactgggtctgggacagacttcactctcaccatcagcagactgcaacctgaagattttgcagtgtatttctgt

SEQ ID NO: 10626 - DNA, 108 bp, Artificial Sequence
  Synthetic construct
agattggagagtggggtcccatccaggttcagcggcagtggatctgggacggattacactctcaccatcagcaccctgcagcctgaagattttgcaacttatttctgt

SEQ ID NO: 10627 - DNA, 114 bp, Artificial Sequence
  Synthetic construct
ggccagggctctggagtccccagccgcttctctgcgtccaaagatgcttcagccaatacagggattttactcatctccgggctccagtctgaggatgaggctgactattactgt

SEQ ID NO: 10628 - DNA, 108 bp, Artificial Sequence
  Synthetic construct
aatttggaaacaggggtcccatcaaggttcagtggaggtggttctgggacacattttactttcaacataagcagcctgcagcctgaagatattggaacatattactgt

SEQ ID NO: 10629 - DNA, 108 bp, Artificial Sequence
  Synthetic construct
actttacaagttggggtcccatccaggttcagcggcgatggatttgggacagatttcacgctcaccatcagcagcctgcagcctgaagattccgcaacttactattgt

SEQ ID NO: 10630 - DNA, 108 bp, Artificial Sequence
  Synthetic construct
aacagggccactggcatccccgccaggttcagtggcagtgggtttgggacagacttcactctcaccatcagcagcctagagcctgacgattttgctgtttattactgt

SEQ ID NO: 10631 - DNA, 108 bp, Artificial Sequence
  Synthetic construct
aagcgctccccagggactcctgaccgaatccatggcttccggtctggcacgtcagccagagtggccatcaccgacctccaaactggggacgaggccgactattactgc

SEQ ID NO: 10632 - DNA, 108 bp, Artificial Sequence
  Synthetic construct
atccgggaatccggggtccctgaccgattcagtggcagcgggtctgggacagatttcactctcaccatcagcagcctgcaggctgaagatgtggcaatttattactgt

SEQ ID NO: 10633 - DNA, 108 bp, Artificial Sequence
  Synthetic construct
cagcggccctcaggggtccctgaccgattctctggctccaagtctggcatctcagcctccctggccatcagtgggctccaggctgaggatgaggctgattattactgt

SEQ ID NO: 10634 - DNA, 108 bp, Artificial Sequence
  Synthetic construct
ctgcggccctcaggggtccctgaccgattctctggctccaagtctggcacctcagcctccctggccatcagtggcctccagtctggagatgaggctgattatttctgt

SEQ ID NO: 10635 - DNA, 108 bp, Artificial Sequence
  Synthetic construct
agtttgcaaagtggggtcccatcaaggttcagcggcagtggatctgggacagatttcactctcaccatcagcagcctgcagcctgaagattttgcaacttactattgt

SEQ ID NO: 10636 - DNA, 108 bp, Artificial Sequence
  Synthetic construct
agtttccaaagtggggtcccatcaaggttcagtggcagttcatctgggacagatttcactctcaccatcaccagtctgcaacctgaagactttgcaacttactactgt

SEQ ID NO: 10637 - DNA, 108 bp, Artificial Sequence
  Synthetic construct
gaccggccctcagggatccctgagcgattttccggctccaattctgggaacacggccaccctgatcatctccagggtcgaagccggggatgaggccgactatttttgt

SEQ ID NO: 10638 - DNA, 108 bp, Artificial Sequence
  Synthetic construct
aagcgaccctcagggactcctgaccgagtccacggcttcaggtctggcacgtcagccaggttggtcatcaccgaactccacactggggacgaggccgattattactgc

SEQ ID NO: 10639 - DNA, 108 bp, Artificial Sequence
  Synthetic construct
acattggaaagtggggtcccatccaggttcagtggcagtggatctgggacggattacactctcaccatcaccagcctgcagcctgaagatttagcgacttattattgt

SEQ ID NO: 10640 - DNA, 108 bp, Artificial Sequence
  Synthetic construct
accagggccactggcatcccagacaggttcagtggcagtgggtctgagacagacttcactctcaccatcagcagcctggagcctgaagattttgcagtgtatcactgt

SEQ ID NO: 10641 - DNA, 108 bp, Artificial Sequence
  Synthetic construct
aatcgggcctccggggtccctgacaggttcagtggcgctggatcaggcacagatttcacactgaaaatcaacagcgtggagcctggcgacgtggggatttatttctgc

SEQ ID NO: 10642 - DNA, 108 bp, Artificial Sequence
  Synthetic construct
actttgcaaaacggggtcccatcaaagttcagtggcagtggatctgggacagatttcactctcaccatcatcggtctgcaacctgacgattttgcgacttactactgt

SEQ ID NO: 10643 - DNA, 108 bp, Artificial Sequence
  Synthetic construct
aatcggccctcagggatttctaatcgcttctctggctccaagtctggcaacacggcctccctgactatctctgggctccaggctgaggacgaggctgcttattactgc

SEQ ID NO: 10644 - DNA, 108 bp, Artificial Sequence
  Synthetic construct
aatcgggcctccggggtccctgacagattcagtggcagtggatcaggcacagattttacactgaaaatcagcagagtggaggctgaggatgttggggtttattactgc

SEQ ID NO: 10645 - DNA, 108 bp, Artificial Sequence
  Synthetic construct
aagcgaccctcagggattcctgaccgattctctggctccaagtctggcacgtcagccaccctgggcatcaccggactccagactggggacgaggccgattattactgc

SEQ ID NO: 10646 - DNA, 62 bp, Artificial Sequence
  Synthetic construct
gcaacacggcctccctgaccatctctgggctccaggctgacgacgaggctgattattactgc

SEQ ID NO: 10647 - DNA, 108 bp, Artificial Sequence
  Synthetic construct
aatttgcaaagtggggtcccatcaaggttcagtggcagtggatctgggacagatttcactctcaccatcagcagtctgcaacctgaagattttgcaacttactactgt

SEQ ID NO: 10648 - DNA, 108 bp, Artificial Sequence
  Synthetic construct
aatttggatgtcggggccccatcgaggttcagcggaagtggatccgggacagagttcactttcaccatcaataacctgcagcctgatgatgttgcaatttattactgt

SEQ ID NO: 10649 - DNA, 108 bp, Artificial Sequence
  Synthetic construct
actttgcaaagtggggtcccatcaaggtttagcggcagtggatctgggacagatttcactctcaccatcagctgcctgcagtctgaggatttcgcaacttattactgt

SEQ ID NO: 10650 - DNA, 108 bp, Artificial Sequence
  Synthetic construct
acccgggaatccggggtccttgaccgattcagtggcagcgggtctgggacagatttcactctcaccatcagcagccttcaggctgaagatgtggcagtttattactgt

SEQ ID NO: 10651 - DNA, 108 bp, Artificial Sequence
  Synthetic construct
aacagggccactggcatcccagccaggttcagtggcagtgggtctgggacagacttcactctcaccatcagcagcctcgagcctgaagatttcgcagtttattactgt

SEQ ID NO: 10652 - DNA, 108 bp, Artificial Sequence
  Synthetic construct
tctttagaaaatggggtcccatcaagattcagcggcagtgggtctgggacagaatttactctcaccatcagcagcctgcaggctgatgattttgcaacttattattgc

SEQ ID NO: 10653 - DNA, 108 bp, Artificial Sequence
  Synthetic construct
actttgcaaagtggggtcccatcaaggttcagcggcggtggatctgggacaaatttcactctcaccatcaactgcctgcagtctgaagattttgcaacatattactgt

SEQ ID NO: 10654 - DNA, 108 bp, Artificial Sequence
  Synthetic construct
agcagggccactggcatcccagacaggttcagtggcagtgggtctgggacagacttcactctcaccatcagcagactggagcctgaagattctgcagtatattactgt

SEQ ID NO: 10655 - DNA, 108 bp, Artificial Sequence
  Synthetic construct
actttgcaatatggggtcccatcaaggttcagcggtagtggatctgggacagaattcactctcacaatcagcagcctgcagcctgaagattttgcaacttattactgt

SEQ ID NO: 10656 - DNA, 108 bp, Artificial Sequence
  Synthetic construct
acccgggaatccggggtccctgcccgattcagtggcagcgggtctgggacagatttcactctcaccatcagcagcctgcaggctgaagatgtggcagtgtattactgt

SEQ ID NO: 10657 - DNA, 108 bp, Artificial Sequence
  Synthetic construct
aacaagggggacgggatccctggtcgcttctcaggctccagctctggggctgagcgctacctcaccatctccagcctccagtctgaggatgaagctgactattattgt

SEQ ID NO: 10658 - DNA, 108 bp, Artificial Sequence
  Synthetic construct
aatcggccctcaggggtccctgaccgaatctctggctccaagtctggcacctcagcctccctggccatcgctgggctccaacctgcggatgaggctgattattactgt

SEQ ID NO: 10659 - DNA, 108 bp, Artificial Sequence
  Synthetic construct
accagggccactggtatcccagccaggttcagtggcagtgggtctgggacagagttcactctcaccatcagcagcctgcagtctgaagattttgcagtttactactgt

SEQ ID NO: 10660 - DNA, 108 bp, Artificial Sequence
  Synthetic construct
ctcagggcccctggcatcccagccaggttcagtggcagtgggtctgggacagacttcactctcatcatcaacaacctcgagcctgaagattttgcgatttattcctgt

SEQ ID NO: 10661 - DNA, 108 bp, Artificial Sequence
  Synthetic construct
agtttggaaagtggggtcccatcaaggttcagcggcagtggatctgggacagagttcactctcaccatcagcagcctgcagcctgaggattttgcaatttattactgt

SEQ ID NO: 10662 - DNA, 108 bp, Artificial Sequence
  Synthetic construct
aacaaacactcctggacccctgcccggttctcaggctccctccttgggggcaaagctgccctgacactgtcaggtgtgcagcctgaggacgaggctgagtattactgc

SEQ ID NO: 10663 - DNA, 108 bp, Artificial Sequence
  Synthetic construct
agtttagaaactggggtcccatcaaggttcagcggcagtggatctgggacagaattcactctcaccatcagcagcctgcagcctgatgattttgcaacttattactgc

SEQ ID NO: 10664 - DNA, 108 bp, Artificial Sequence
  Synthetic construct
actttagaaagtggggtcccatcaaggttcagcggcagtgcatctgagacagaattcactctcaccatcagcagcctgcagcctgatgattttgcaacttattattgc

SEQ ID NO: 10665 - DNA, 108 bp, Artificial Sequence
  Synthetic construct
aacagggccactggcatcccagacaggttcagtggcagtgggtctgggacagacttcactctcaccatcagcaggctggagcctgaagattttgcagtgtattactgt

SEQ ID NO: 10666 - DNA, 108 bp, Artificial Sequence
  Synthetic construct
aaccggccctcagggatcccagaccgattctctggctccacttcaggaaacacagcttccttgaccatcactggggctcaggcggaagatgaggctgactattattgt

SEQ ID NO: 10667 - DNA, 108 bp, Artificial Sequence
  Synthetic construct
aatttgcagacaggggtcccatcaaggttcagtggaagtggatctgggacagattttactttcaccatcagcagcctgcagcctgaagatattgcaacatattactgt

SEQ ID NO: 10668 - DNA, 108 bp, Artificial Sequence
  Synthetic construct
actttgcaaagtggggtcccaccaaggttcagtggcagtggatctgggacaaatttcactctcaccatcaccaatctgcaacctgaagattttgcaacttactactgt

SEQ ID NO: 10669 - DNA, 108 bp, Artificial Sequence
  Synthetic construct
agtttagaaagtggggtcccatcaaggttcagcggcagtggatctgggacagaattcactctcaccatcagcagcctgcagcctgatgattttgtgacttattactgc

SEQ ID NO: 10670 - DNA, 108 bp, Artificial Sequence
  Synthetic construct
agtttgcaaagtggggtcccatcaaggttcagtggcagtggatttgggacagatttcactctcaccatcagcagtctgcaacctgaagattttgcaacttactactgt

SEQ ID NO: 10671 - DNA, 108 bp, Artificial Sequence
  Synthetic construct
caccggccctcagggatccctgagcgattctctggctccaattctgactccacggccacccttagcatcagcagtgtcgaggcctgggatgaggccgactattactgc

SEQ ID NO: 10672 - DNA, 108 bp, Artificial Sequence
  Synthetic construct
actttgaaaagtggggtcccatcaaggttcagtggcagtggatctgggacagagttcactctcaccatcagcagtctgcaacctgaagattttgcaacttactattgt

SEQ ID NO: 10673 - DNA, 108 bp, Artificial Sequence
  Synthetic construct
agtttgcgaagtggggtcccgtcaaggttcagtggcagtggatctgggacagatttcactctcaccatcagcagtctgcaacctgaagattttgcagcttactactgt

SEQ ID NO: 10674 - DNA, 108 bp, Artificial Sequence
  Synthetic construct
cagcggccctcagggatttctgatcgcttctctggctccaagtctggcaacacggcctccctgacaatctctgggctccaggctgaggacgaggctgattatttctgc

SEQ ID NO: 10675 - DNA, 108 bp, Artificial Sequence
  Synthetic construct
aacagggccactggcatcccagccagattcggtggcagtgggtctgggacagacttcattctcaccatcagcagcctagagcctgaagattttgcagtgtattactgt

SEQ ID NO: 10676 - DNA, 108 bp, Artificial Sequence
  Synthetic construct
aagcgcccctcagggatccctgagcgaatctctggctccaactctgggaacacagccactctgaccatcaccggggcccaggctatggatgaggctgactattactgt

SEQ ID NO: 10677 - DNA, 108 bp, Artificial Sequence
  Synthetic construct
acccgggaatccggggtccctgaccgattcagtggcagcgggtctggagtgaatttcactctcaccatcagcagcctgcaggctacagatgtggcagtttattactgt

SEQ ID NO: 10678 - DNA, 108 bp, Artificial Sequence
  Synthetic construct
cagcggccctcaggggtccctgcccgattctctggctccaagtttggcacctcagcctccctggccatcagtgggctccggtctgcggatgaggctgtttatttctgt

SEQ ID NO: 10679 - DNA, 108 bp, Artificial Sequence
  Synthetic construct
aagcgaccctcagggattcctgaccgattctctggctccaagtctggcacgtcagccaccctggaaatcagcggactccagcctggggacgaggccgattattattgc

SEQ ID NO: 10680 - DNA, 108 bp, Artificial Sequence
  Synthetic construct
actttgcaaagtggggtcccatcaaggttcagcggcagtggatctgggacagatttcactctcaccatcagcagcctgcagcctgaagatgttgcaacttattactgt

SEQ ID NO: 10681 - DNA, 108 bp, Artificial Sequence
  Synthetic construct
agtttgcaaagtggggtcccgtcaaggttcagtggcagtggatctgggacagatttcactctcaccatcagcagtctgcaacctgaagattttgcaaccttctactgt

SEQ ID NO: 10682 - DNA, 108 bp, Artificial Sequence
  Synthetic construct
accagggccactggcatctcagacaggttcagtggccgtgggtctgggacagacttcactctcaccatcagcagactggagcctgaagattttgcagtgtattactgt

SEQ ID NO: 10683 - DNA, 108 bp, Artificial Sequence
  Synthetic construct
actttagaaactggggtcccatcgaggttcatcggcagtggatctgggacagagttcactctgaccatcagcagcctacagcctgatgattttgcaatttattactgc

SEQ ID NO: 10684 - DNA, 108 bp, Artificial Sequence
  Synthetic construct
agtttgcagagtggggtcccatcaaggttcagtggcagtggatctgggacagatttcactctcaccatcagcaatctgcaacctgaggactttgcaacttactactgt

SEQ ID NO: 10685 - DNA, 108 bp, Artificial Sequence
  Synthetic construct
atcagggcctctggcatcccagacaggttcagtggcagtgggtctgggatcgacttcactctcaccatcaacagactggagcctgaggattttgcagtgtatcactgt

SEQ ID NO: 10686 - DNA, 108 bp, Artificial Sequence
  Synthetic construct
aaacggccctcaggggtccctgaccgattctctggctccaagtctggcacctcagcctccctggccatcactgggctccaggctgaggatgaggctgtttattactgc

SEQ ID NO: 10687 - DNA, 108 bp, Artificial Sequence
  Synthetic construct
agtttgcaaaatggggtcccatcaaagttcagtggcagtggatctgggacagattttactctcaccatcagcggtctacaacctgaggattttgcgacttactactgt

SEQ ID NO: 10688 - DNA, 108 bp, Artificial Sequence
  Synthetic construct
tccagggccgctgacatcccgtccaggttcagtggcagtgggtctgggacagaattcactctcaccatcagcagcctgcagtctgaagattctgcagtttactactgc

SEQ ID NO: 10689 - DNA, 108 bp, Artificial Sequence
  Synthetic construct
aagcgggacgctggggtcccagacagattcgacggcagtgggtcaggcactgacttcacactgaagatcaatagggtggaggctgaggatcttggaatttattactgc

SEQ ID NO: 10690 - DNA, 108 bp, Artificial Sequence
  Synthetic construct
aacagggccactggcatcccagcccggttcagtggcagtgggtctgggacagacttcactctcaccatcagtagcctagagtctgaagattttgcaatttactactgt

SEQ ID NO: 10691 - DNA, 108 bp, Artificial Sequence
  Synthetic construct
aatcggccctcaggaatttctgatcgcttctctgcctccaagtctggcaatacggcctccctgaccatctctgggctccagattgaggacgagggggactatagttgc

SEQ ID NO: 10692 - DNA, 108 bp, Artificial Sequence
  Synthetic construct
caccggccctcagggatccctgagcgattctctggctccaattctgactccacggccacccttagcatcagcagtgtcgaggccggggatgaggccgactattactgc

SEQ ID NO: 10693 - DNA, 108 bp, Artificial Sequence
  Synthetic construct
actcgggagtccggggtccctgaccgattcagtggcagcgggtctgggacagatttcactctcaccatcagcagcctgcaggctgaggatgtggcagtttatttctgt

SEQ ID NO: 10694 - DNA, 108 bp, Artificial Sequence
  Synthetic construct
gagcggccctcagggatccctgagcgattctctggctccaactctgggaacacagccactctgaccatcagcgggacccaggctatggatgaggctgactattactgt

SEQ ID NO: 10695 - DNA, 108 bp, Artificial Sequence
  Synthetic construct
acccggcccactgacatcccagacaggttcagtggcagtgggtctgggacagacttcactctcaccatcagcagactggagcctgaagattttgcaacatattactgt

SEQ ID NO: 10696 - DNA, 108 bp, Artificial Sequence
  Synthetic construct
aatcggccctcaggggtccctgaccgagtctctgagtccaagtctggcacctcagcctccctggccatcactgggctccaggctgaggatgaggctgattattattgc

SEQ ID NO: 10697 - DNA, 108 bp, Artificial Sequence
  Synthetic construct
agtttgcaaagtggggtcccatcaagattcagtggcagtggatctgggacagatttcactctcaccatcagcagtctgcaacctgaagattttgcaacttactactgt

SEQ ID NO: 10698 - DNA, 108 bp, Artificial Sequence
  Synthetic construct
agtttacaaagtggggtcccatcaaggttcagcggcagtggatctggcacagaattcactctcaccatcagcagcctgcagcctgaagattttgcaacttattactgt

SEQ ID NO: 10699 - DNA, 108 bp, Artificial Sequence
  Synthetic construct
agtttgcaaagtggggtcccatcaaggttcagtggcagtggatctgggacagatttcactctcaccatcagcagtctgcaacctgaagattttgcaacttacttctgt

SEQ ID NO: 10700 - DNA, 108 bp, Artificial Sequence
  Synthetic construct
aacacggccactggtttcccagccaggttcagtggcagtgggtctgggacagagttcactctcaccatcagcagcctgcagtctgaagattttgccgtttattactgt

SEQ ID NO: 10701 - DNA, 108 bp, Artificial Sequence
  Synthetic construct
aaccggccctcagggatccctgagcgattctctggctccaacccagggaataccgccaccctaaccatcagcaggatcgaggctgggggtgagactgactattactgt

SEQ ID NO: 10702 - DNA, 108 bp, Artificial Sequence
  Synthetic construct
agagtggaaagtggggtcccatccaggttcagtggcagtggatctgggacggattacactctcaccatcagcagcctgcagcctgaagattttgcaacttattactgt

SEQ ID NO: 10703 - DNA, 108 bp, Artificial Sequence
  Synthetic construct
gaccggccctcagggatccctgcgcgaatctctggctccaactctggaaacatggccaccctgaccatcagcggggtcgaagccggggatgaggccgactattattgt

SEQ ID NO: 10704 - DNA, 108 bp, Artificial Sequence
  Synthetic construct
aatcgaccctcaggggtccctgaccgattctctggctccaagtctggcacctcagcctccctggccatcactgggctccaggctgaggatgaggctgattattactgc

SEQ ID NO: 10705 - DNA, 108 bp, Artificial Sequence
  Synthetic construct
atgcgaccctcactgattcctgaccgattctctgcctctaagtccggcacgtcagccaccctggacatcaccggactccagactggggacgaggccgattattactgc

SEQ ID NO: 10706 - DNA, 108 bp, Artificial Sequence
  Synthetic construct
agcagggccactggcatcccagacaggttcagtggcagtgggtctgggaccgacttcactctcaccatcagcagactggagcctgaagattttgcagtgtattactgt

SEQ ID NO: 10707 - DNA, 108 bp, Artificial Sequence
  Synthetic construct
agccggttctctggagtgccagataggttcagtggcagcgggtcagggacagatttcacactgaaaatcagccgggtggaggctgaggatgttggggtttattactgc

SEQ ID NO: 10708 - DNA, 108 bp, Artificial Sequence
  Synthetic construct
accagggccactggtatcccagccaggttcagtggcagtgggtctgggacagagttcactctcaccatcagcggcctgcagtctgaagattttgcagtttatttctgt

SEQ ID NO: 10709 - DNA, 108 bp, Artificial Sequence
  Synthetic construct
aagcggccctcaggggtttctaatcgcttctctggctccaagtctggcaacacggcctccctgacaatctctggactccaggctgaggacgaggctgattattactgc

SEQ ID NO: 10710 - DNA, 108 bp, Artificial Sequence
  Synthetic construct
aatcggcccttaggggtttctaatcgcttctctggctccaagtctggcaacacggcctccctgaccatctctgggctccggactgaggacgaggctgattattattgc

SEQ ID NO: 10711 - DNA, 108 bp, Artificial Sequence
  Synthetic construct
cagcggccctcaggggtccctgcccgattctctggctccaagtctggcgcgtccgcctccctgaccatcagtgggctccaggctgaggatgaggctgattattattgt

SEQ ID NO: 10712 - DNA, 108 bp, Artificial Sequence
  Synthetic construct
agtttgcaaagtggggtcccttcaaggttccgtggcagtggctctgggacagatttcactctcaccattaccagtctccaacctgaagattttgcaacttactactgt

SEQ ID NO: 10713 - DNA, 33 bp, Artificial Sequence
  Synthetic construct
ctccaggctgacgacgaggctgattattactgc

SEQ ID NO: 10714 - DNA, 108 bp, Artificial Sequence
  Synthetic construct
gagaggccctcagggatccctgagcgattctctggctccagctcagggacaacagtcacgttgaccatcagcggagtccaggcagaagacgaggctgactatttctgt

SEQ ID NO: 10715 - DNA, 108 bp, Artificial Sequence
  Synthetic construct
aacagggccactggcatcccagccaggttcagtggcagtgggtctgggacagacttcactctcaccatcagcagtctagagcctgaagattttgcagtttattactgt

SEQ ID NO: 10716 - DNA, 108 bp, Artificial Sequence
  Synthetic construct
aatcggccctcaggggtttctcatcgcttctctggctccaagtctggaaacacggcctccctgaccatctctggactccaggctgaggacgaggctgattatttctgc

SEQ ID NO: 10717 - DNA, 108 bp, Artificial Sequence
  Synthetic construct
actttagaaagtggggtcccatcgaggttcagcggcagtggatctgggacagaattcactctcaccatcagcagcctgcagcctgatgattttgcaacttattactgc

SEQ ID NO: 10718 - DNA, 108 bp, Artificial Sequence
  Synthetic construct
aacagggccactgacatcccagacaggttcagtggcagtgggtctgggacagacttcactctcaccatcagcagactggagcctgaagattttgcagtgtatttctgt

SEQ ID NO: 10719 - DNA, 108 bp, Artificial Sequence
  Synthetic construct
gagaggcccccagggatccctgagcgattctctggctccagctctgggacaacagtcacattgaccatcagtggagtccaggcagaagacgaggctgactactactgt

SEQ ID NO: 10720 - DNA, 108 bp, Artificial Sequence
  Synthetic construct
agcagggccagtggcgtcccagacaggttcggtggcagtgggtctgggacagacttcactctcagcatcagcagactggagcctgaagattatgcagtgtattactgt

SEQ ID NO: 10721 - DNA, 108 bp, Artificial Sequence
  Synthetic construct
actttgcagagtggggtcccatcaaggttcagcggcagtggatctgggacagaattcactctcacgatcagcagcctgcagcctgaagactatgcaacttattactgt

SEQ ID NO: 10722 - DNA, 108 bp, Artificial Sequence
  Synthetic construct
aagcgaccctcagggattcctgaccgattctctggctccaagtctggcacgtcagccaccctgggcatcagcggactccagactggggacgaggccgattattactgc

SEQ ID NO: 10723 - DNA, 108 bp, Artificial Sequence
  Synthetic construct
accttacagcgtggagtcccatcacggttcagcggcagtgcatctgggacagacttcactctcacaatcagcagcctgcagcctgaagattttgcaacttattattgt

SEQ ID NO: 10724 - DNA, 108 bp, Artificial Sequence
  Synthetic construct
cagcggccctcaggggtttctaatcgcttctctggctccaagtctggcaacacggcctccctgacaatctctgggctccaggctgaggacgaggctgattattactgc

SEQ ID NO: 10725 - DNA, 108 bp, Artificial Sequence; identical to SEQ ID NO: 1858
  Synthetic construct

SEQ ID NO: 10726 - DNA, 108 bp, Artificial Sequence
  Synthetic construct
caccggccctctgggatccctgaccgattctctggctccaactctgacaacgcggccaccctgaccgtcaacagggtcgaagccggggatgaggccgactattattgt

SEQ ID NO: 10727 - DNA, 108 bp, Artificial Sequence
  Synthetic construct
agtcgggccacgggcatcccagacaggttccttggcagtgggtctgggacagacttcactctcaccatcagcagactggagcctgaagattttgcagtgtattactgt

SEQ ID NO: 10728 - DNA, 108 bp, Artificial Sequence
  Synthetic construct
aggttgcaaagtggggtcccatcaaggttcagcggcagtggatctgggacagatttcactctcaccatcagcagcctgcagcctgacgattttgcaaattactattgt

SEQ ID NO: 10729 - DNA, 108 bp, Artificial Sequence
  Synthetic construct
agtagggccactggcatctcagacaggttcagtggcagtgggtctgggacagacttcactctcaccatcagcagactggagcctgaggattttgcagtgtattactgt

SEQ ID NO: 10730 - DNA, 108 bp, Artificial Sequence
  Synthetic construct
agcagggccactggcatcccagacaggttcagtggcagtgggtccgggacagacttcattctctccatcagcagactggagcctgaagattttgcagtgtattactgt

SEQ ID NO: 10731 - DNA, 108 bp, Artificial Sequence
  Synthetic construct
gaccggccctcagacatccctgagcgattctcgggctccaactctgggaacacggccaccctgaccatcagcagggtcgaggccggggatgaggccgactattactgt

SEQ ID NO: 10732 - DNA, 108 bp, Artificial Sequence
  Synthetic construct
aagcggccctcaggggtttctaatcgcttctctggctccaagtctgacaacacggccttcctgacaatctctgaaatacaggctgaggacgaggctgaatattattgc

SEQ ID NO: 10733 - DNA, 108 bp, Artificial Sequence
  Synthetic construct
aatcggccctcaggggtccctgaccgattctctggctccaagtctgacgcctcagcctccctggtcatcactgggctccaggctgaggatgaggctgattatttctgc

SEQ ID NO: 10734 - DNA, 108 bp, Artificial Sequence
  Synthetic construct
aatttagaaactgggatcccatcaaggttcagcggcagtggatctgggacagacttcactctcaccatcagcagcctgcagcctgatgattttgcaacttattactgc

SEQ ID NO: 10735 - DNA, 31 bp, Artificial Sequence
  Synthetic construct
ttcggccaagggacacgactggaaagtaaac

SEQ ID NO: 10736 - DNA, 31 bp, Artificial Sequence
  Synthetic construct
tttggccaggggaccaagctggacatgaaac

SEQ ID NO: 10737 - DNA, 31 bp, Artificial Sequence
  Synthetic construct
ttcggaactgggaccaaggtcaccgtcctag

SEQ ID NO: 10738 - DNA, 31 bp, Artificial Sequence
  Synthetic construct
ttcggccaagggaccaaggtggacatcaaac

SEQ ID NO: 10739 - DNA, 31 bp, Artificial Sequence
  Synthetic construct
ttcggccctgggaccagagtggatatcaaac

SEQ ID NO: 10740 - DNA, 31 bp, Artificial Sequence
  Synthetic construct
tttggccaggggaccaacctggaaatcaaac

SEQ ID NO: 10741 - DNA, 31 bp, Artificial Sequence
  Synthetic construct
ttcggcggagggaccacgctgaccgtcctag

SEQ ID NO: 10742 - DNA, 31 bp, Artificial Sequence
  Synthetic construct
ttcggcggagggaccgacctgaccgtcctgg

SEQ ID NO: 10743 - DNA, 31 bp, Artificial Sequence
  Synthetic construct
ttcggccaagggaccaaggtggaaatcaaac

SEQ ID NO: 10744 - DNA, 31 bp, Artificial Sequence
  Synthetic construct
tttggcccggggaccaagctggagatcaaac

SEQ ID NO: 10745 - DNA, 31 bp, Artificial Sequence
  Synthetic construct
ttcggcggagggaccaagctgaccgtcctcg

SEQ ID NO: 10746 - DNA, 31 bp, Artificial Sequence
  Synthetic construct
ttcggccctgggaccaaagtgggtatcaaac

SEQ ID NO: 10747 - DNA, 31 bp, Artificial Sequence
  Synthetic construct
ttcggcggagggacccacctggccgtcctgg

SEQ ID NO: 10748 - DNA, 31 bp, Artificial Sequence
  Synthetic construct
ttcggcggagggaccaagctgaccgtcctag

SEQ ID NO: 10749 - DNA, 31 bp, Artificial Sequence
  Synthetic construct
ttcggccaagggacacgactggagattaaac

SEQ ID NO: 10750 - DNA, 31 bp, Artificial Sequence
  Synthetic construct
ttcggccctgggaccaaagtgggtgtcaaac

SEQ ID NO: 10751 - DNA, 31 bp, Artificial Sequence
  Synthetic construct
ttcggcggagggaccaggctgaccgtcccag

SEQ ID NO: 10752 - DNA, 31 bp, Artificial Sequence
  Synthetic construct
ttcggccaagggaccaaggtggaagtcaaac

SEQ ID NO: 10753 - DNA, 31 bp, Artificial Sequence
  Synthetic construct
ttcggctctgggaccaaggtcaccgtcctag

SEQ ID NO: 10754 - DNA, 31 bp, Artificial Sequence
  Synthetic construct
ttcggcggtgggaccagggtgaccgtcctca

SEQ ID NO: 10755 - DNA, 31 bp, Artificial Sequence
  Synthetic construct
tttggccaggggaccaaggtggagattaacc

SEQ ID NO: 10756 - DNA, 31 bp, Artificial Sequence
  Synthetic construct
tttggccaggggaccaagctggagatcaaac

SEQ ID NO: 10757 - DNA, 31 bp, Artificial Sequence
  Synthetic construct
ttcggccaagggtccaaggtggaaatcaaac

SEQ ID NO: 10758 - DNA, 31 bp, Artificial Sequence; identical to SEQ ID NO: 1859
  Synthetic construct

SEQ ID NO: 10759 - DNA, 31 bp, Artificial Sequence
  Synthetic construct
ttcggcccagggacccacctggagatcaacc

SEQ ID NO: 10760 - DNA, 31 bp, Artificial Sequence
  Synthetic construct
ttcggcggagggaccaagttgaccgtcctag

SEQ ID NO: 10761 - DNA, 31 bp, Artificial Sequence
  Synthetic construct
ttcggcggggggacaaagttgaccgtcctag

SEQ ID NO: 10762 - DNA, 31 bp, Artificial Sequence
  Synthetic construct
ttcggaactgggaccgaggtcaccgtcctag

SEQ ID NO: 10763 - DNA, 31 bp, Artificial Sequence
  Synthetic construct
ttcggccctgggaccaaagtggatatcaaac

SEQ ID NO: 10764 - DNA, 31 bp, Artificial Sequence
  Synthetic construct
ttcggacttgggaccacggtcaccgtcctac

SEQ ID NO: 10765 - DNA, 31 bp, Artificial Sequence
  Synthetic construct
ttcggcggagggaccaaggtgaccgtcctag

SEQ ID NO: 10766 - DNA, 31 bp, Artificial Sequence
  Synthetic construct
ttcggaaatgggaccaaggtgatagtcctgg

SEQ ID NO: 10767 - DNA, 31 bp, Artificial Sequence
  Synthetic construct
tttggcccggggaccaagctggagatcagag

SEQ ID NO: 10768 - DNA, 12 bp, Artificial Sequence
  Synthetic construct
ttcggccgaggg

SEQ ID NO: 10769 - DNA, 31 bp, Artificial Sequence; identical to SEQ ID NO: 1862
  Synthetic construct

SEQ ID NO: 10770 - DNA, 31 bp, Artificial Sequence
  Synthetic construct
ttcggaaatgggaccagggtcgccgtcctcg

SEQ ID NO: 10771 - DNA, 31 bp, Artificial Sequence; identical to SEQ ID NO: 1863
  Synthetic construct

SEQ ID NO: 10772 - DNA, 31 bp, Artificial Sequence
  Synthetic construct
ttcggaattgggaccaaggtcaccgtcctag

SEQ ID NO: 10773 - DNA, 31 bp, Artificial Sequence
  Synthetic construct
tatggccaggggaccaagctggagatcaaac

SEQ ID NO: 10774 - DNA, 31 bp, Artificial Sequence
  Synthetic construct
tttggccaggggaccaaggtggagatcaaac

SEQ ID NO: 10775 - DNA, 31 bp, Artificial Sequence
  Synthetic construct
ttcggcggagggaccaaggtgaccgtcctgg

SEQ ID NO: 10776 - DNA, 31 bp, Artificial Sequence
  Synthetic construct
ttcggaactgggaccaaggtcatcgtcctag

SEQ ID NO: 10777 - DNA, 31 bp, Artificial Sequence
  Synthetic construct
ttcggccaagggacacggctggacattaaac

SEQ ID NO: 10778 - DNA, 31 bp, Artificial Sequence
  Synthetic construct
ttcggccaggggaccaaggtggaaatcaaac

SEQ ID NO: 10779 - DNA, 31 bp, Artificial Sequence
  Synthetic construct
ttcggcggaggggccaagctgaccgtcctag

SEQ ID NO: 10780 - DNA, 31 bp, Artificial Sequence
  Synthetic construct
ttcggccctgggaccaaagtggagatcaaac

SEQ ID NO: 10781 - DNA, 31 bp, Artificial Sequence
  Synthetic construct
ttcggccctgggaccaaagtggaaatcaaac

SEQ ID NO: 10782 - DNA, 31 bp, Artificial Sequence
  Synthetic construct
ttcggcccagggacccaggtagaagtcagac

SEQ ID NO: 10783 - DNA, 31 bp, Artificial Sequence
  Synthetic construct
ttcgggcctgggaccaaagtggatatgaaac

SEQ ID NO: 10784 - DNA, 31 bp, Artificial Sequence
  Synthetic construct
ttcggcggagggaccagggtggagatcaaac

SEQ ID NO: 10785 - DNA, 31 bp, Artificial Sequence
  Synthetic construct
tttggccaagggaccagggtggaaatcaaac

SEQ ID NO: 10786 - DNA, 31 bp, Artificial Sequence
  Synthetic construct
tttggccaggggaccaagctggagatcaacc

SEQ ID NO: 10787 - DNA, 31 bp, Artificial Sequence
  Synthetic construct
ttcggcggcgggaccaaggtggagatcagac

SEQ ID NO: 10788 - DNA, 31 bp, Artificial Sequence
  Synthetic construct
ttcggcggcgggaccaaggtgcagatcaaac

SEQ ID NO: 10789 - DNA, 31 bp, Artificial Sequence
  Synthetic construct
tttggccccgggaccaaggtcgatagcaaac

SEQ ID NO: 10790 - DNA, 31 bp, Artificial Sequence
  Synthetic construct
ttcggccctgggaccacagtggaaatcaaac

SEQ ID NO: 10791 - DNA, 31 bp, Artificial Sequence
  Synthetic construct
ttcggccctgggaccaaactggatatcaaac

SEQ ID NO: 10792 - DNA, 31 bp, Artificial Sequence
  Synthetic construct
tttgcccaggggaccaaactggagatcaaac

SEQ ID NO: 10793 - DNA, 31 bp, Artificial Sequence
  Synthetic construct
ttcggcagagggacgaagctgatcgtcctag

SEQ ID NO: 10794 - DNA, 31 bp, Artificial Sequence
  Synthetic construct
ttcggaagtgggaccaaggtcaccgtcctag

SEQ ID NO: 10795 - DNA, 31 bp, Artificial Sequence
  Synthetic construct
ttcggcggagggacgaagctgaccgtcctag

SEQ ID NO: 10796 - DNA, 31 bp, Artificial Sequence
  Synthetic construct
ttcgtcggagggaccaagctgaccgtcctag

SEQ ID NO: 10797 - DNA, 31 bp, Artificial Sequence
  Synthetic construct
ttcggcggagggaccaggctgaccgtcctag

SEQ ID NO: 10798 - DNA, 31 bp, Artificial Sequence
  Synthetic construct
ttcggcggagggaccaacctgaccgtcctaa

SEQ ID NO: 10799 - DNA, 31 bp, Artificial Sequence
  Synthetic construct
ttcggcggagggaccaacctgaccgtcctag

SEQ ID NO: 10800 - DNA, 31 bp, Artificial Sequence
  Synthetic construct
ttcggcggagggcccaagctgaccgtcctag

SEQ ID NO: 10801 - DNA, 31 bp, Artificial Sequence
  Synthetic construct
ttcggcggagggaccaagcggaccgtcctag

SEQ ID NO: 10802 - DNA, 31 bp, Artificial Sequence
  Synthetic construct
ttcggcggagggaccaaggtggagatcagac

SEQ ID NO: 10803 - DNA, 31 bp, Artificial Sequence
  Synthetic construct
ttcggcctagggaccaaggtggaaatcaaac

SEQ ID NO: 10804 - DNA, 31 bp, Artificial Sequence
  Synthetic construct
ttcggcggcgggaccaggctgaccgtcctga

SEQ ID NO: 10805 - DNA, 31 bp, Artificial Sequence
  Synthetic construct
ttcggaagtgggaccaaggtcaccgttgtag

SEQ ID NO: 10806 - DNA, 31 bp, Artificial Sequence
  Synthetic construct
ttcggcggggggaccaagctgaccgtcctag

SEQ ID NO: 10807 - DNA, 31 bp, Artificial Sequence
  Synthetic construct
ttcggaggaggcacccacctgaccgtcctcg

SEQ ID NO: 10808 - DNA, 31 bp, Artificial Sequence
  Synthetic construct
ttcggcggggggaccaagctgaccgtcctgg

SEQ ID NO: 10809 - DNA, 31 bp, Artificial Sequence
  Synthetic construct
ttcggcggagggaccaaggtggagatccaac

SEQ ID NO: 10810 - DNA, 31 bp, Artificial Sequence
  Synthetic construct
ttcggcggcgggaccaagttgaccgtcctag

SEQ ID NO: 10811 - DNA, 31 bp, Artificial Sequence
  Synthetic construct
tttggccaggggaccaagctggacatcaaac

SEQ ID NO: 10812 - DNA, 31 bp, Artificial Sequence
  Synthetic construct
ttcggcggagggaccaagttgaccgtcctcg

SEQ ID NO: 10813 - DNA, 31 bp, Artificial Sequence
  Synthetic construct
ttcggcggagggaccaagctgaccgtcctac

SEQ ID NO: 10814 - DNA, 31 bp, Artificial Sequence
  Synthetic construct
ttcggcggagggaccaaactgaccgtcctag

SEQ ID NO: 10815 - DNA, 31 bp, Artificial Sequence
  Synthetic construct
ttcggccaggggaccagggtggatatcaagc

SEQ ID NO: 10816 - DNA, 31 bp, Artificial Sequence
  Synthetic construct
tttggccaggggaccaagctggagatcagac

SEQ ID NO: 10817 - DNA, 31 bp, Artificial Sequence
  Synthetic construct
tttggccaggggaccaaggtggagatcagcc

SEQ ID NO: 10818 - DNA, 31 bp, Artificial Sequence
  Synthetic construct
tttggccaggggaccaagttggagatcaaac

SEQ ID NO: 10819 - DNA, 31 bp, Artificial Sequence
  Synthetic construct
ttcggcggagggaccaaggtcgagatcaaac

SEQ ID NO: 10820 - DNA, 31 bp, Artificial Sequence
  Synthetic construct
ttcggccaagggaccaaggtggaaatcaacc

SEQ ID NO: 10821 - DNA, 31 bp, Artificial Sequence
  Synthetic construct
tttggccaggggacgaaactggagatcaagc

SEQ ID NO: 10822 - DNA, 31 bp, Artificial Sequence
  Synthetic construct
tttggccaggggaccatactggagatcaaac

SEQ ID NO: 10823 - DNA, 31 bp, Artificial Sequence
  Synthetic construct
atcggcggcgggaccaagctgaccgtcctag

SEQ ID NO: 10824 - DNA, 31 bp, Artificial Sequence
  Synthetic construct
ttcggcggggggaccaaggtggacgtcaagc

SEQ ID NO: 10825 - DNA, 31 bp, Artificial Sequence
  Synthetic construct
tttggccaggggaccaacctggagatcaaac

SEQ ID NO: 10826 - DNA, 14 bp, Artificial Sequence
  Synthetic construct
ttcggccaagggac

SEQ ID NO: 10827 - DNA, 31 bp, Artificial Sequence
  Synthetic construct
ttcggccaagggacccaggtggaaatcaaac

SEQ ID NO: 10828 - DNA, 31 bp, Artificial Sequence
  Synthetic construct
ttcggccaggggaccaaggtggaggtcaaac

SEQ ID NO: 10829 - DNA, 31 bp, Artificial Sequence
  Synthetic construct
ttcggcggagggaccaaggtggaggtcaaac

SEQ ID NO: 10830 - DNA, 31 bp, Artificial Sequence
  Synthetic construct
ttcggcggagggaccaaggtggagatcaacc

SEQ ID NO: 10831 - DNA, 31 bp, Artificial Sequence
  Synthetic construct
ttcggcggcgggaccaagctgaccgtcctag

SEQ ID NO: 10832 - DNA, 31 bp, Artificial Sequence
  Synthetic construct
tttggccaggggaccaagctggagatcaagc

SEQ ID NO: 10833 - DNA, 31 bp, Artificial Sequence
  Synthetic construct
ttcggcggacagaccaagctgaccgtcctag

SEQ ID NO: 10834 - DNA, 31 bp, Artificial Sequence
  Synthetic construct
tttggccaggggaccaaactggagatcaaac

SEQ ID NO: 10835 - DNA, 31 bp, Artificial Sequence
  Synthetic construct
ttcggaagtgggaccacagtcaccgtcctaa

SEQ ID NO: 10836 - DNA, 31 bp, Artificial Sequence
  Synthetic construct
tttggccaggggaccaagctggagatcaatc

SEQ ID NO: 10837 - DNA, 31 bp, Artificial Sequence
  Synthetic construct
ttcggccaagggacacgattggagattaacc

SEQ ID NO: 10838 - DNA, 31 bp, Artificial Sequence
  Synthetic construct
ttcggcggagggaccaagctgaccgtcgtag

SEQ ID NO: 10839 - DNA, 31 bp, Artificial Sequence
  Synthetic construct
ttcggaactgggaccaaggtcaccgtccttg

SEQ ID NO: 10840 - DNA, 31 bp, Artificial Sequence
  Synthetic construct
ttcggcggagggaccaaggtggagatcaccc

SEQ ID NO: 10841 - DNA, 31 bp, Artificial Sequence
  Synthetic construct
tttggccgggggtccaagctggagatcgaac

SEQ ID NO: 10842 - DNA, 31 bp, Artificial Sequence
  Synthetic construct
ttcggccaagggaccaaggtggaaagcagac

SEQ ID NO: 10843 - DNA, 31 bp, Artificial Sequence
  Synthetic construct
ttcggccaagggaccaaggtggagatcaaac

SEQ ID NO: 10844 - DNA, 31 bp, Artificial Sequence
  Synthetic construct
ttcggaactgggaccaaggtcaccgttctgg

SEQ ID NO: 10845 - DNA, 31 bp, Artificial Sequence
  Synthetic construct
ttcggccctgggaccaaagtggatgtcaaac

SEQ ID NO: 10846 - DNA, 31 bp, Artificial Sequence
  Synthetic construct
ttcggcggcgggaccaagctcattgtcctaa

SEQ ID NO: 10847 - DNA, 31 bp, Artificial Sequence
  Synthetic construct
ttcggaagtgggaccgaggtcaccgtcctag

SEQ ID NO: 10848 - DNA, 31 bp, Artificial Sequence
  Synthetic construct
ttcggccaagggaccaaagtagaaatcaatc

SEQ ID NO: 10849 - DNA, 31 bp, Artificial Sequence
  Synthetic construct
ttcggccaagggaccaaggtggaaatcagac

SEQ ID NO: 10850 - DNA, 31 bp, Artificial Sequence
  Synthetic construct
ttcggcggagggaccagactgaccgtcctag

SEQ ID NO: 10851 - DNA, 31 bp, Artificial Sequence
  Synthetic construct
ttcggccaagggaccagggtggaagtcaaac

SEQ ID NO: 10852 - DNA, 31 bp, Artificial Sequence
  Synthetic construct
ttcggagctgggaccaaggtcaccgtcctag

SEQ ID NO: 10853 - DNA, 31 bp, Artificial Sequence
  Synthetic construct
tttggccaggggaccaacgtggagatcaaac

SEQ ID NO: 10854 - DNA, 31 bp, Artificial Sequence
  Synthetic construct
ttcggccaagggaccagggtggaaatcaaaa

SEQ ID NO: 10855 - DNA, 31 bp, Artificial Sequence
  Synthetic construct
ttcggccaggggaccacggtggaaatcaaag

SEQ ID NO: 10856 - DNA, 31 bp, Artificial Sequence
  Synthetic construct
ttcggccaagggaccagggtggaaatcagac

SEQ ID NO: 10857 - DNA, 31 bp, Artificial Sequence
  Synthetic construct
ttcggaaccgggaccaaggtcaccgtcctag

SEQ ID NO: 10858 - DNA, 31 bp, Artificial Sequence
  Synthetic construct
ttcggccaagggacacgtctggagattaaac

SEQ ID NO: 10859 - DNA, 31 bp, Artificial Sequence
  Synthetic construct
ttcggaagtccgaccacggtcatcgtccttg

SEQ ID NO: 10860 - DNA, 31 bp, Artificial Sequence
  Synthetic construct
ttcggcccggggaccaagctgcacgtcaaac

SEQ ID NO: 10861 - DNA, 31 bp, Artificial Sequence
  Synthetic construct
ttcggcggagggaccaaggtggagctcaaac

SEQ ID NO: 10862 - DNA, 31 bp, Artificial Sequence
  Synthetic construct
ttcggccaagggaccaaggtggaaatcaagc

SEQ ID NO: 10863 - DNA, 31 bp, Artificial Sequence
  Synthetic construct
ttcggcccggggaccaaggtggaaatcaagc

SEQ ID NO: 10864 - DNA, 31 bp, Artificial Sequence
  Synthetic construct
ttcggccctgggaccaaagtggatctcaaac

SEQ ID NO: 10865 - DNA, 31 bp, Artificial Sequence
  Synthetic construct
tttggccaggggaccaaggtggaatccaaac

SEQ ID NO: 10866 - DNA, 31 bp, Artificial Sequence
  Synthetic construct
ttcggcggagggaccaggctgaccgtcgtag

SEQ ID NO: 10867 - DNA, 31 bp, Artificial Sequence
  Synthetic construct
ttcggcggagggaccaagctgaccgtccttg

SEQ ID NO: 10868 - DNA, 31 bp, Artificial Sequence; identical to SEQ ID NO: 1861
  Synthetic construct

SEQ ID NO: 10869 - DNA, 31 bp, Artificial Sequence
  Synthetic construct
ttcggccaagggaccagggtggaaatcaaac

SEQ ID NO: 10870 - DNA, 31 bp, Artificial Sequence
  Synthetic construct
ttcggcggagggaccaggatgaccgtcctag

SEQ ID NO: 10871 - DNA, 31 bp, Artificial Sequence
  Synthetic construct
ttcggcggagggaccaaagtgaccgtcctaa

SEQ ID NO: 10872 - DNA, 31 bp, Artificial Sequence
  Synthetic construct
ttcggccaagggaccaaggttgaagtcaaac

SEQ ID NO: 10873 - DNA, 31 bp, Artificial Sequence
  Synthetic construct
tttggtcaggggactgaactggatctcaaac

SEQ ID NO: 10874 - DNA, 31 bp, Artificial Sequence
  Synthetic construct
ttcggacctgggaccaaggtcaccgtcctac

SEQ ID NO: 10875 - DNA, 31 bp, Artificial Sequence
  Synthetic construct
ttcggccaagggacacgactggagattaagc

SEQ ID NO: 10876 - DNA, 31 bp, Artificial Sequence
  Synthetic construct
ttcggcggaggtaccaaggtgaccgtcctaa

SEQ ID NO: 10877 - DNA, 31 bp, Artificial Sequence
  Synthetic construct
ttcggcagtggcaccaaggtgaccgtcctcg

SEQ ID NO: 10878 - DNA, 31 bp, Artificial Sequence
  Synthetic construct
ttcggcggcgggaccaaggtggagatcaagc

SEQ ID NO: 10879 - DNA, 31 bp, Artificial Sequence
  Synthetic construct
ttcggcggtgggaccaagctgaccgtcctac

SEQ ID NO: 10880 - DNA, 31 bp, Artificial Sequence
  Synthetic construct
ttcggcgaagggaccaagctgaccgtcctag

SEQ ID NO: 10881 - DNA, 31 bp, Artificial Sequence
  Synthetic construct
ttcggaactcagaccaaggtcaccgtcctga

SEQ ID NO: 10882 - DNA, 31 bp, Artificial Sequence
  Synthetic construct
ttcgcaactgggaccaaggtcaccgtcctag

SEQ ID NO: 10883 - DNA, 31 bp, Artificial Sequence
  Synthetic construct
ttcggccccgggaccaaggtggaaatcaaac

SEQ ID NO: 10884 - DNA, 31 bp, Artificial Sequence
  Synthetic construct
ttcggccaagggaccaaggtggaaatcacac

SEQ ID NO: 10885 - DNA, 31 bp, Artificial Sequence
  Synthetic construct
ttcggtcaggggaccaaggtggaagtcaaac

SEQ ID NO: 10886 - DNA, 31 bp, Artificial Sequence
  Synthetic construct
ttcggccaagggaccaaggtggatctcaatc

SEQ ID NO: 10887 - DNA, 31 bp, Artificial Sequence
  Synthetic construct
tttggcggagggaccaagctgaccgtcctag

SEQ ID NO: 10888 - DNA, 31 bp, Artificial Sequence
  Synthetic construct
ttcggccctgggaccacagtcaatatcaaac

SEQ ID NO: 10889 - DNA, 31 bp, Artificial Sequence
  Synthetic construct
tttggccaggggaccaggctggagatcaaac

SEQ ID NO: 10890 - DNA, 31 bp, Artificial Sequence
  Synthetic construct
ttcggccctgggaccgtagtggatatcaaac

SEQ ID NO: 10891 - DNA, 31 bp, Artificial Sequence
  Synthetic construct
tttggcggagggaccaagcggaccgtccgag

SEQ ID NO: 10892 - DNA, 31 bp, Artificial Sequence
  Synthetic construct
ttcggccctgggaccacagttgatatcaaac

SEQ ID NO: 10893 - DNA, 31 bp, Artificial Sequence
  Synthetic construct
ttcggcggcgggaccaaggtggagatcaaac

SEQ ID NO: 10894 - DNA, 31 bp, Artificial Sequence
  Synthetic construct
ttcggcggagggaccaaggtggacatcacac

SEQ ID NO: 10895 - DNA, 31 bp, Artificial Sequence
  Synthetic construct
ttcggcggagggactaagctgaccgtcctaa

SEQ ID NO: 10896 - DNA, 31 bp, Artificial Sequence
  Synthetic construct
ttcggccctgggaccaaagtggatgccaaac

SEQ ID NO: 10897 - DNA, 31 bp, Artificial Sequence
  Synthetic construct
ttcggcggagggaccaagctgaccgtcctaa

SEQ ID NO: 10898 - DNA, 31 bp, Artificial Sequence
  Synthetic construct
ttcggccctgggaccacagtggatatcaaac

SEQ ID NO: 10899 - DNA, 31 bp, Artificial Sequence
  Synthetic construct
ttcggaactgggaccaaggtcaccgtcctaa

SEQ ID NO: 10900 - DNA, 31 bp, Artificial Sequence
  Synthetic construct
ttcggcagagggaccaaggtgaccgtcctag

SEQ ID NO: 10901 - DNA, 31 bp, Artificial Sequence
  Synthetic construct
ttcggcggagggaccgagctgaccgtcctag

SEQ ID NO: 10902 - DNA, 31 bp, Artificial Sequence
  Synthetic construct
ttcggccctgggaccaaactggatatcaagc

SEQ ID NO: 10903 - DNA, 31 bp, Artificial Sequence
  Synthetic construct
ttcggccaggggacacgactggagattaaaa

SEQ ID NO: 10904 - DNA, 31 bp, Artificial Sequence
  Synthetic construct
ttcggcggagggacaaagctgaccgtcctag

SEQ ID NO: 10905 - DNA, 31 bp, Artificial Sequence
  Synthetic construct
ttcggccaggggacgaaggtggaaatcaaac

SEQ ID NO: 10906 - DNA, 31 bp, Artificial Sequence
  Synthetic construct
ttcggcccagggaccaaggtggaaatcagac

SEQ ID NO: 10907 - DNA, 31 bp, Artificial Sequence
  Synthetic construct
ttcggccctgggaccatagtggatatcaaac

SEQ ID NO: 10908 - DNA, 31 bp, Artificial Sequence
  Synthetic construct
ttcggccctgggacctcagtggatatcaaac

SEQ ID NO: 10909 - DNA, 31 bp, Artificial Sequence
  Synthetic construct
ttcggcggagggaccaagctgaccgtcttag

SEQ ID NO: 10910 - DNA, 31 bp, Artificial Sequence
  Synthetic construct
ttcggccgagggaccaaggtggaaatcaagc

SEQ ID NO: 10911 - DNA, 31 bp, Artificial Sequence
  Synthetic construct
ttcggcggagggaccaacgttgagatgaaac

SEQ ID NO: 10912 - DNA, 31 bp, Artificial Sequence
  Synthetic construct
ttcggcggcgggaccaagctgaccgtcctaa

SEQ ID NO: 10913 - DNA, 31 bp, Artificial Sequence
  Synthetic construct
ttcggccaagggacacgactggatattaagc

SEQ ID NO: 10914 - DNA, 31 bp, Artificial Sequence
  Synthetic construct
ttcggccaagggaccaaggtggaagtcaagc

SEQ ID NO: 10915 - DNA, 31 bp, Artificial Sequence
  Synthetic construct
tttggccaggggaccaagttggaggtcaaac

SEQ ID NO: 10916 - DNA, 31 bp, Artificial Sequence
  Synthetic construct
ttcggaagtgggacccaggtcatcgtcctag

SEQ ID NO: 10917 - DNA, 31 bp, Artificial Sequence
  Synthetic construct
ttcggcccggggaccagagtggatatcaaac

SEQ ID NO: 10918 - DNA, 31 bp, Artificial Sequence
  Synthetic construct
ttcggcggtgggaccgagctgaccgtcctag

SEQ ID NO: 10919 - DNA, 31 bp, Artificial Sequence
  Synthetic construct
ttcggcggagggaccaaggtggagatcactc

SEQ ID NO: 10920 - DNA, 31 bp, Artificial Sequence
  Synthetic construct
ttcggccaggggaccaagttggagatcaaac

SEQ ID NO: 10921 - DNA, 31 bp, Artificial Sequence
  Synthetic construct
ttcggacctgggaccaaggtcaccgtcctag

SEQ ID NO: 10922 - DNA, 31 bp, Artificial Sequence; identical to SEQ ID NO: 1860
  Synthetic construct

SEQ ID NO: 10923 - DNA, 31 bp, Artificial Sequence
  Synthetic construct
tttggccaggggaccagactggagatcaagc

SEQ ID NO: 10924 - DNA, 31 bp, Artificial Sequence
  Synthetic construct
ttcggccaagggaccaaggtggaagtcagac

SEQ ID NO: 10925 - DNA, 31 bp, Artificial Sequence
  Synthetic construct
ttcgggactgggaccaaggtcaccgtcctag

SEQ ID NO: 10926 - DNA, 31 bp, Artificial Sequence
  Synthetic construct
ttcggccctgggaccagagtggagatcagac

SEQ ID NO: 10927 - DNA, 31 bp, Artificial Sequence
  Synthetic construct
ttcggcggggggaccatcctggagatcagac

SEQ ID NO: 10928 - DNA, 31 bp, Artificial Sequence
  Synthetic construct
tttggccaggggaccaaggtagagatcaaac

SEQ ID NO: 10929 - DNA, 31 bp, Artificial Sequence
  Synthetic construct
tttggccaggggaccaagttggagagcaaac

SEQ ID NO: 10930 - DNA, 31 bp, Artificial Sequence
  Synthetic construct
ttcggaactgggaccacggtcaccgtcctac

SEQ ID NO: 10931 - DNA, 31 bp, Artificial Sequence
  Synthetic construct
ttcggccaagggacacgactggaaattaaac

SEQ ID NO: 10932 - DNA, 31 bp, Artificial Sequence
  Synthetic construct
ttcggcggagggaccaaggtagagatcaaac

SEQ ID NO: 10933 - DNA, 31 bp, Artificial Sequence
  Synthetic construct
tttggtggagggaccaggctgaccgtcgtag

SEQ ID NO: 10934 - DNA, 31 bp, Artificial Sequence
  Synthetic construct
ttcggcggagggacctcggtggagagaaaac

SEQ ID NO: 10935 - DNA, 31 bp, Artificial Sequence
  Synthetic construct
ttcggcggggggaccaaggtggagatcaaac

SEQ ID NO: 10936 - DNA, 31 bp, Artificial Sequence
  Synthetic construct
tttggccgggggaccaagttggagatcaaac

SEQ ID NO: 10937 - DNA, 31 bp, Artificial Sequence
  Synthetic construct
ttcggacctgggacccaggtcaccgtcctag

SEQ ID NO: 10938 - DNA, 31 bp, Artificial Sequence
  Synthetic construct
ttcggacctgggaccaaggtcatcgtccttg

SEQ ID NO: 10939 - DNA, 31 bp, Artificial Sequence
  Synthetic construct
ttcggccctgggaccaaggtggatatcaaac

SEQ ID NO: 10940 - DNA, 31 bp, Artificial Sequence
  Synthetic construct
ttcggaagtgggaccaaggtcaccgtcctaa

SEQ ID NO: 10941 - DNA, 31 bp, Artificial Sequence
  Synthetic construct
ttcggcggagggaccagggtggagatgaaac

SEQ ID NO: 10942 - DNA, 31 bp, Artificial Sequence
  Synthetic construct
ttcggcggagggaccaagctcaccgtcctgg

SEQ ID NO: 10943 - DNA, 31 bp, Artificial Sequence
  Synthetic construct
ttcggccaagggaccaagctggaaatcaaaa

SEQ ID NO: 10944 - DNA, 31 bp, Artificial Sequence
  Synthetic construct
ttcggcggagggaccacggtggagatcaaac

SEQ ID NO: 10945 - DNA, 31 bp, Artificial Sequence
  Synthetic construct
tttggcccggggaccaaggttgagatcaaac

SEQ ID NO: 10946 - DNA, 31 bp, Artificial Sequence
  Synthetic construct
ttcggccaagggaccaaggtggaaatgaaac

SEQ ID NO: 10947 - DNA, 31 bp, Artificial Sequence
  Synthetic construct
ttcggcggagggaccacggtggaaatcaaac

SEQ ID NO: 10948 - DNA, 31 bp, Artificial Sequence
  Synthetic construct
ttcggcggatggaccaagttgaccgtcctag

SEQ ID NO: 10949 - DNA, 31 bp, Artificial Sequence
  Synthetic construct
ttcgggacagggaccaaggtcaccgtcctag

SEQ ID NO: 10950 - DNA, 31 bp, Artificial Sequence
  Synthetic construct
ttcggccctgggaccaaactggaaatcagcc

SEQ ID NO: 10951 - DNA, 31 bp, Artificial Sequence
  Synthetic construct
ttcggccaagggaccaaagtggaattcaaac

SEQ ID NO: 10952 - DNA, 31 bp, Artificial Sequence
  Synthetic construct
ttcggccaagggaccaaagttgattttaaac

SEQ ID NO: 10953 - DNA, 31 bp, Artificial Sequence
  Synthetic construct
ttcggccctggaaccaaggttgatctcaagc

SEQ ID NO: 10954 - DNA, 31 bp, Artificial Sequence
  Synthetic construct
tttggcggggggaccaagctgaccgtcctag

SEQ ID NO: 10955 - DNA, 31 bp, Artificial Sequence
  Synthetic construct
ttcggcggagggaccaatgtagagatcaaac

SEQ ID NO: 10956 - DNA, 31 bp, Artificial Sequence
  Synthetic construct
ttcggcggagggaccagggtggagatcaatc

SEQ ID NO: 10957 - DNA, 31 bp, Artificial Sequence
  Synthetic construct
ttcggcggagggaccaagatgcagatcaaac

SEQ ID NO: 10958 - DNA, 31 bp, Artificial Sequence
  Synthetic construct
ttcgcccaagggacacgactggagattaaac

SEQ ID NO: 10959 - DNA, 31 bp, Artificial Sequence
  Synthetic construct
ttcggcggtgggaccaagctgaccgtcctag

SEQ ID NO: 10960 - DNA, 31 bp, Artificial Sequence
  Synthetic construct
ttcggcagagggaccaagttgaccgtcctgc

SEQ ID NO: 10961 - DNA, 31 bp, Artificial Sequence
  Synthetic construct
ttcggcggcgggaccaaggtggagatcaatc

SEQ ID NO: 10962 - DNA, 31 bp, Artificial Sequence
  Synthetic construct
ttcggtcaagggaccaaggtggaaatcaaac

SEQ ID NO: 10963 - DNA, 31 bp, Artificial Sequence
  Synthetic construct
ttcggcggagggaccaaggtggagttcaagc

SEQ ID NO: 10964 - DNA, 31 bp, Artificial Sequence
  Synthetic construct
ttcggccaagggaccaaggtggagatcaaag

SEQ ID NO: 10965 - DNA, 31 bp, Artificial Sequence
  Synthetic construct
tttggccaggggaccagcctggagatcaaaa

SEQ ID NO: 10966 - DNA, 31 bp, Artificial Sequence
  Synthetic construct
tttggccaggggaccaaactggagatcaaag

SEQ ID NO: 10967 - DNA, 31 bp, Artificial Sequence
  Synthetic construct
tttggccaggggaccaagctggaaatcaagc

SEQ ID NO: 10968 - DNA, 31 bp, Artificial Sequence
  Synthetic construct
ttcggaactgggaccaaggtcaccgtcctcc

SEQ ID NO: 10969 - DNA, 31 bp, Artificial Sequence
  Synthetic construct
ttcggcggagggaccaaggtggagatcaagc

SEQ ID NO: 10970 - DNA, 31 bp, Artificial Sequence
  Synthetic construct
ttcggccaagggaccagggtggacgtcagac

SEQ ID NO: 10971 - DNA, 31 bp, Artificial Sequence
  Synthetic construct
tttggccaggggaccaagctggagatcacgc

SEQ ID NO: 10972 - DNA, 31 bp, Artificial Sequence
  Synthetic construct
ttcggcggagggaccaaggtgaccgtccttg

SEQ ID NO: 10973 - DNA, 31 bp, Artificial Sequence
  Synthetic construct
ttcggaactgggaccaaactcaccgtcctag

SEQ ID NO: 10974 - DNA, 31 bp, Artificial Sequence
  Synthetic construct
ttcggccctgggactaaagtgggtatcagac

SEQ ID NO: 10975 - DNA, 31 bp, Artificial Sequence
  Synthetic construct
ttcggcctagggaccaagttggaaatcaaac

SEQ ID NO: 10976 - DNA, 31 bp, Artificial Sequence
  Synthetic construct
ttcggccaagggaccaaggtggtactccaac

SEQ ID NO: 10977 - DNA, 31 bp, Artificial Sequence
  Synthetic construct
ttcggcggagggaccaaactgaccgtccttg

SEQ ID NO: 10978 - DNA, 31 bp, Artificial Sequence
  Synthetic construct
ttcggcggagggaccaagttgaccttcctag

SEQ ID NO: 10979 - DNA, 31 bp, Artificial Sequence
  Synthetic construct
ttcggccgagggaccaaggtggaaatcaaac

SEQ ID NO: 10980 - DNA, 31 bp, Artificial Sequence
  Synthetic construct
ttcggccctgggaccaaagtggatttgaaac

SEQ ID NO: 10981 - DNA, 31 bp, Artificial Sequence
  Synthetic construct
ttcggccaagggaccaaggtggagctcaatc

SEQ ID NO: 10982 - DNA, 8 bp, Artificial Sequence
  Synthetic construct
tttggcca

SEQ ID NO: 10983 - DNA, 31 bp, Artificial Sequence
  Synthetic construct
ttcggccaagggaccaagttggaaatcaaac

SEQ ID NO: 10984 - DNA, 31 bp, Artificial Sequence
  Synthetic construct
tttggcggagggaccaagttgaccgtcctac

SEQ ID NO: 10985 - DNA, 31 bp, Artificial Sequence
  Synthetic construct
ttcggccaggggaccagggtggaaatcaagc

SEQ ID NO: 10986 - DNA, 31 bp, Artificial Sequence
  Synthetic construct
ttcggccctgggaccaaagtggatttcaaac

SEQ ID NO: 10987 - DNA, 31 bp, Artificial Sequence
  Synthetic construct
ttcggccctgggaccaaagtggatatcaaag

SEQ ID NO: 10988 - DNA, 31 bp, Artificial Sequence
  Synthetic construct
tttggccaggggaccaagctggaggtcaaac

SEQ ID NO: 10989 - DNA, 31 bp, Artificial Sequence
  Synthetic construct
ttcggccctgggaccaaaatagatattaaac

SEQ ID NO: 10990 - DNA, 31 bp, Artificial Sequence
  Synthetic construct
ttcggcggtgggaccaaggtggagatcaagc

SEQ ID NO: 10991 - DNA, 31 bp, Artificial Sequence
  Synthetic construct
ttcggacctggcaccaaagtcaccgtcctgg

SEQ ID NO: 10992 - DNA, 31 bp, Artificial Sequence
  Synthetic construct
ttcggcggagggaccaagttgaccgtcctgg

SEQ ID NO: 10993 - DNA, 31 bp, Artificial Sequence
  Synthetic construct
ttcggcggagggaccaagctgaccgtcctta

SEQ ID NO: 10994 - DNA, 31 bp, Artificial Sequence
  Synthetic construct
ttcggccctgggaccaaggtggatctcaaac

SEQ ID NO: 10995 - DNA, 31 bp, Artificial Sequence
  Synthetic construct
ttcggcggagggaccagggtggagatcaacc

SEQ ID NO: 10996 - DNA, 31 bp, Artificial Sequence
  Synthetic construct
ttcggccaagggaccaaggtggaattgaaac

SEQ ID NO: 10997 - DNA, 31 bp, Artificial Sequence
  Synthetic construct
ttcggcggagggacccagttgaccgtcctag

SEQ ID NO: 10998 - DNA, 31 bp, Artificial Sequence
  Synthetic construct
ttcggccaagggaccaaggtggaggtccaac

SEQ ID NO: 10999 - DNA, 31 bp, Artificial Sequence
  Synthetic construct
ttcggccaagggacacgactggagcttaatc

SEQ ID NO: 11000 - DNA, 31 bp, Artificial Sequence
  Synthetic construct
ttcgggtctgggaccacggtcgccgtcctcg

SEQ ID NO: 11001 - DNA, 31 bp, Artificial Sequence
  Synthetic construct
tttggtcaggggaccaagctggagatcagac

SEQ ID NO: 11002 - DNA, 31 bp, Artificial Sequence
  Synthetic construct
tttggccaggggaccaagctggggatcaaac

SEQ ID NO: 11003 - DNA, 31 bp, Artificial Sequence
  Synthetic construct
tttggccaggggaccaagctggagatcagag

SEQ ID NO: 11004 - DNA, 31 bp, Artificial Sequence
  Synthetic construct
ttcggaactggcaccaaggtcaccgtcctgc

SEQ ID NO: 11005 - DNA, 31 bp, Artificial Sequence
  Synthetic construct
ttcggaggtgggaccaagatcaccgtcgtag

SEQ ID NO: 11006 - DNA, 31 bp, Artificial Sequence
  Synthetic construct
ttcggcggcgggaccaaggtgaccgtcctag

SEQ ID NO: 11007 - DNA, 31 bp, Artificial Sequence
  Synthetic construct
ttcggccctgggaccaaagtggatatcagac

SEQ ID NO: 11008 - DNA, 31 bp, Artificial Sequence
  Synthetic construct
ttcggaactgggaccaaggtcaccgtcctgg

SEQ ID NO: 11009 - DNA, 31 bp, Artificial Sequence
  Synthetic construct
ttcggacctgggaccagggtctccgtcctag

SEQ ID NO: 11010 - DNA, 31 bp, Artificial Sequence
  Synthetic construct
ttcggccaagggaccaaggttgagatcaaac

SEQ ID NO: 11011 - DNA, 31 bp, Artificial Sequence
  Synthetic construct
ttcggaacaggaaccacggtcaccgtcctac

SEQ ID NO: 11012 - DNA, 31 bp, Artificial Sequence
  Synthetic construct
ttcggccaagggaccaaggtggaggtcaaac

SEQ ID NO: 11013 - DNA, 31 bp, Artificial Sequence
  Synthetic construct
tttggccaggggaccaagctggacatcaagc

SEQ ID NO: 11014 - DNA, 31 bp, Artificial Sequence
  Synthetic construct
ttcggcggcgggaccaagttgaccgtcctgg

SEQ ID NO: 11015 - DNA, 31 bp, Artificial Sequence
  Synthetic construct
ttcggccaggggaccaaggtggaagtcagac

SEQ ID NO: 11016 - DNA, 31 bp, Artificial Sequence; identical to SEQ ID NO: 1864
  Synthetic construct

SEQ ID NO: 11017 - DNA, 31 bp, Artificial Sequence
  Synthetic construct
tttggcggagggaccaagttgaccgtcctag

SEQ ID NO: 11018 - DNA, 31 bp, Artificial Sequence
  Synthetic construct
ttcggccctgggaccaaagtggatatcaacc

SEQ ID NO: 11019 - DNA, 31 bp, Artificial Sequence
  Synthetic construct
ttcggacctgggacgaagctcaccgtcctag

SEQ ID NO: 11020 - DNA, 31 bp, Artificial Sequence
  Synthetic construct
ttcggaactgggaccaaggtcaccgtcatgg

SEQ ID NO: 11021 - DNA, 31 bp, Artificial Sequence
  Synthetic construct
ttcggaactggaaccaaggtcaccgtcctag

SEQ ID NO: 11022 - DNA, 31 bp, Artificial Sequence
  Synthetic construct
tttggccaggggaccaggttggagatcaaac

SEQ ID NO: 11023 - DNA, 21 bp, Artificial Sequence
  Synthetic construct
cagagtgttagcagcaggtac

SEQ ID NO: 11024 - DNA, 18 bp, Artificial Sequence
  Synthetic construct
gagggtataagtaactac

SEQ ID NO: 11025 - DNA, 27 bp, Artificial Sequence
  Synthetic construct
agcagtgacgttggtggttataactat

SEQ ID NO: 11026 - DNA, 18 bp, Artificial Sequence
  Synthetic construct
gatgatcttgacaatcat

SEQ ID NO: 11027 - DNA, 21 bp, Artificial Sequence
  Synthetic construct
cagggtgttcacagcaacact

SEQ ID NO: 11028 - DNA, 21 bp, Artificial Sequence
  Synthetic construct
cagagtcttagcaacacctcg

SEQ ID NO: 11029 - DNA, 27 bp, Artificial Sequence
  Synthetic construct
actggagctgtcaccagtggtcattat

SEQ ID NO: 11030 - DNA, 27 bp, Artificial Sequence
  Synthetic construct
agccgtgatgttggtgttcataagtct

SEQ ID NO: 11031 - DNA, 21 bp, Artificial Sequence
  Synthetic construct
cagagtgttagcagcaattac

SEQ ID NO: 11032 - DNA, 18 bp, Artificial Sequence
  Synthetic construct
cagagtgttagtacctgg

SEQ ID NO: 11033 - DNA, 27 bp, Artificial Sequence
  Synthetic construct
agcagtgacgttggtggttataaatat

SEQ ID NO: 11034 - DNA, 36 bp, Artificial Sequence
  Synthetic construct
cagagtgttttatacagctccaacaataagacctac

SEQ ID NO: 11035 - DNA, 18 bp, Artificial Sequence
  Synthetic construct
ggattgccaaaacaatat

SEQ ID NO: 11036 - DNA, 18 bp, Artificial Sequence
  Synthetic construct
cagactctttacacccac

SEQ ID NO: 11037 - DNA, 30 bp, Artificial Sequence
  Synthetic construct
cagaatgttttatacgacaataagaactac

SEQ ID NO: 11038 - DNA, 21 bp, Artificial Sequence
  Synthetic construct
cagagtgttagcagcacctac

SEQ ID NO: 11039 - DNA, 27 bp, Artificial Sequence
  Synthetic construct
tgcagtgacgttggtggttataactat

SEQ ID NO: 11040 - DNA, 36 bp, Artificial Sequence
  Synthetic construct
cagagtgttttatacaggtccaagaatcagaactac

SEQ ID NO: 11041 - DNA, 27 bp, Artificial Sequence
  Synthetic construct
agctccaacatcggggcaggttatgat

SEQ ID NO: 11042 - DNA, 27 bp, Artificial Sequence
  Synthetic construct
agcagtgacgtcggtggttataactat

SEQ ID NO: 11043 - DNA, 36 bp, Artificial Sequence
  Synthetic construct
cagagtgttttatacacctccaacaatgagcactac

SEQ ID NO: 11044 - DNA, 18 bp, Artificial Sequence
  Synthetic construct
agcctcagaaaccattat

SEQ ID NO: 11045 - DNA, 24 bp, Artificial Sequence
  Synthetic construct
agtggcagtattggcagcaacttt

SEQ ID NO: 11046 - DNA, 36 bp, Artificial Sequence
  Synthetic construct
cagagtcttttatatagcgccaccgagaggacctac

SEQ ID NO: 11047 - DNA, 18 bp, Artificial Sequence
  Synthetic construct
cagaacatcgagactgcc

SEQ ID NO: 11048 - DNA, 21 bp, Artificial Sequence
  Synthetic construct
cagcctgttaccagcggctac

SEQ ID NO: 11049 - DNA, 21 bp, Artificial Sequence
  Synthetic construct
cggagtgttaccagcgactac

SEQ ID NO: 11050 - DNA, 21 bp, Artificial Sequence
  Synthetic construct
cagagtgtgagcagcacctac

SEQ ID NO: 11051 - DNA, 21 bp, Artificial Sequence
  Synthetic construct
cagactgttagcagcaggtac

SEQ ID NO: 11052 - DNA, 18 bp, Artificial Sequence
  Synthetic construct
aactttgaaactacagat

SEQ ID NO: 11053 - DNA, 24 bp, Artificial Sequence
  Synthetic construct
agctccaacatcggaagtaatgtt

SEQ ID NO: 11054 - DNA, 18 bp, Artificial Sequence
  Synthetic construct
cagaatattggcaggtat

SEQ ID NO: 11055 - DNA, 27 bp, Artificial Sequence
  Synthetic construct
agcggtgatgttgtaaattatgtcctt

SEQ ID NO: 11056 - DNA, 33 bp, Artificial Sequence
  Synthetic construct
gagagtctcctgtatagtgatggaaagacttat

SEQ ID NO: 11057 - DNA, 18 bp, Artificial Sequence
  Synthetic construct
cagggcattagcagttat

SEQ ID NO: 11058 - DNA, 18 bp, Artificial Sequence
  Synthetic construct
cagggtattagcagttat

SEQ ID NO: 11059 - DNA, 18 bp, Artificial Sequence
  Synthetic construct
gcattgccaggcaattat

SEQ ID NO: 11060 - DNA, 24 bp, Artificial Sequence
  Synthetic construct
agctccaacatcggaagtaattat

SEQ ID NO: 11061 - DNA, 18 bp, Artificial Sequence
  Synthetic construct
cagagtattagtagctgg

SEQ ID NO: 11062 - DNA, 27 bp, Artificial Sequence
  Synthetic construct
agcagagatgttgggagttataacctt

SEQ ID NO: 11063 - DNA, 18 bp, Artificial Sequence
  Synthetic construct
cagggaattagcatctgg

SEQ ID NO: 11064 - DNA, 21 bp, Artificial Sequence
  Synthetic construct
agcggctacagcacttataaa

SEQ ID NO: 11065 - DNA, 18 bp, Artificial Sequence
  Synthetic construct
caggacattgacaattat

SEQ ID NO: 11066 - DNA, 21 bp, Artificial Sequence
  Synthetic construct
cagagtgtaagcagcagcttc

SEQ ID NO: 11067 - DNA, 36 bp, Artificial Sequence
  Synthetic construct
cagagtcttttatacagctccgacaaaaagaactac

SEQ ID NO: 11068 - DNA, 36 bp, Artificial Sequence
  Synthetic construct
cagagtgttttatacagctccaacaataagaactac

SEQ ID NO: 11069 - DNA, 33 bp, Artificial Sequence
  Synthetic construct
caaagcctcctacacagtgatggaaacacctac

SEQ ID NO: 11070 - DNA, 36 bp, Artificial Sequence; identical to SEQ ID NO: 1868
  Synthetic construct

SEQ ID NO: 11071 - DNA, 27 bp, Artificial Sequence
  Synthetic construct
agcagtgacgttggtacttttaagtat

SEQ ID NO: 11072 - DNA, 27 bp, Artificial Sequence
  Synthetic construct
acctcaaacatcggggcaggttatgat

SEQ ID NO: 11073 - DNA, 27 bp, Artificial Sequence
  Synthetic construct
agcagtgatgttgggagttataacctt

SEQ ID NO: 11074 - DNA, 18 bp, Artificial Sequence
  Synthetic construct
aacattggaagtaaaagt

SEQ ID NO: 11075 - DNA, 18 bp, Artificial Sequence
  Synthetic construct
cagagtgttggcagctcc

SEQ ID NO: 11076 - DNA, 33 bp, Artificial Sequence
  Synthetic construct
caaagcctcgtatacagtgatggaaacacctac

SEQ ID NO: 11077 - DNA, 18 bp, Artificial Sequence
  Synthetic construct
cggagtattagcaatacc

SEQ ID NO: 11078 - DNA, 21 bp, Artificial Sequence
  Synthetic construct
agtggacacgacacctacgcc

SEQ ID NO: 11079 - DNA, 21 bp, Artificial Sequence
  Synthetic construct
ccgcgtcttagcagcacctac

SEQ ID NO: 11080 - DNA, 18 bp, Artificial Sequence
  Synthetic construct
cagagtgttgacaagttc

SEQ ID NO: 11081 - DNA, 21 bp, Artificial Sequence
  Synthetic construct
cagaatgttaattggcgctac

SEQ ID NO: 11082 - DNA, 33 bp, Artificial Sequence
  Synthetic construct
caaagcctcgttcacactgatggaaacacctac

SEQ ID NO: 11083 - DNA, 27 bp, Artificial Sequence
  Synthetic construct
aacagtgatgttgggagttataacctt

SEQ ID NO: 11084 - DNA, 36 bp, Artificial Sequence
  Synthetic construct
ccgagtgtcttgtacacctccgacaaaaagaactac

SEQ ID NO: 11085 - DNA, 18 bp, Artificial Sequence
  Synthetic construct
cagagtattagcacctcc

SEQ ID NO: 11086 - DNA, 18 bp, Artificial Sequence
  Synthetic construct
caggacattagaaatgat

SEQ ID NO: 11087 - DNA, 18 bp, Artificial Sequence
  Synthetic construct
caaagtgttagcaccaac

SEQ ID NO: 11088 - DNA, 33 bp, Artificial Sequence
  Synthetic construct
caaagcctcgtacacagtgatggaaacatgtac

SEQ ID NO: 11089 - DNA, 33 bp, Artificial Sequence
  Synthetic construct
caaagcctcgtacacagtgatggaaacacctac

SEQ ID NO: 11090 - DNA, 18 bp, Artificial Sequence
  Synthetic construct
caggacatcactaacttt

SEQ ID NO: 11091 - DNA, 18 bp, Artificial Sequence
  Synthetic construct
caggacataaccaaatat

SEQ ID NO: 11092 - DNA, 18 bp, Artificial Sequence
  Synthetic construct
caggacattagcacttct

SEQ ID NO: 11093 - DNA, 18 bp, Artificial Sequence
  Synthetic construct
cagagtattgacaccttc

SEQ ID NO: 11094 - DNA, 18 bp, Artificial Sequence
  Synthetic construct
cagagcattagcagtttt

SEQ ID NO: 11095 - DNA, 18 bp, Artificial Sequence
  Synthetic construct
cagaccattatcacctat

SEQ ID NO: 11096 - DNA, 18 bp, Artificial Sequence
  Synthetic construct
cagagcattagcagctat

SEQ ID NO: 11097 - DNA, 18 bp, Artificial Sequence
  Synthetic construct
cagagcattagtaattat

SEQ ID NO: 11098 - DNA, 18 bp, Artificial Sequence
  Synthetic construct
caagacattaagaactac

SEQ ID NO: 11099 - DNA, 21 bp, Artificial Sequence
  Synthetic construct
cagagtgtgagttccagttac

SEQ ID NO: 11100 - DNA, 21 bp, Artificial Sequence
  Synthetic construct
cagagtgttaacagcaactac

SEQ ID NO: 11101 - DNA, 21 bp, Artificial Sequence
  Synthetic construct
cagagtgttagcagcagctac

SEQ ID NO: 11102 - DNA, 18 bp, Artificial Sequence
  Synthetic construct
caggatattagcagatac

SEQ ID NO: 11103 - DNA, 18 bp, Artificial Sequence
  Synthetic construct
cagagtgttagtgattgg

SEQ ID NO: 11104 - DNA, 18 bp, Artificial Sequence
  Synthetic construct
cagagtgttagaaccaac

SEQ ID NO: 11105 - DNA, 18 bp, Artificial Sequence
  Synthetic construct
cagagtgttggcagcaac

SEQ ID NO: 11106 - DNA, 18 bp, Artificial Sequence
  Synthetic construct
cagagtgttagcagcaac

SEQ ID NO: 11107 - DNA, 18 bp, Artificial Sequence
  Synthetic construct
caaagtgttagcagcaac

SEQ ID NO: 11108 - DNA, 21 bp, Artificial Sequence
  Synthetic construct
cagagtgttagcagcaactac

SEQ ID NO: 11109 - DNA, 36 bp, Artificial Sequence
  Synthetic construct
cagagtgttttatccagaatcaacgataagaattac

SEQ ID NO: 11110 - DNA, 36 bp, Artificial Sequence
  Synthetic construct
cagagtcttttctacagctccaacaataagacctac

SEQ ID NO: 11111 - DNA, 36 bp, Artificial Sequence
  Synthetic construct
cagactgttttatacacctccactaataagaacttc

SEQ ID NO: 11112 - DNA, 18 bp, Artificial Sequence
  Synthetic construct
gcattgccaaagcaatat

SEQ ID NO: 11113 - DNA, 18 bp, Artificial Sequence
  Synthetic construct
agcctcagaaggtattat

SEQ ID NO: 11114 - DNA, 18 bp, Artificial Sequence
  Synthetic construct
gcattgtcaaagcaatat

SEQ ID NO: 11115 - DNA, 27 bp, Artificial Sequence
  Synthetic construct
agcagtgacgttggtggttataagtat

SEQ ID NO: 11116 - DNA, 27 bp, Artificial Sequence
  Synthetic construct
agcagtgacgttggtagttataactat

SEQ ID NO: 11117 - DNA, 27 bp, Artificial Sequence
  Synthetic construct
agcagtgacgttggtgtttataactat

SEQ ID NO: 11118 - DNA, 27 bp, Artificial Sequence
  Synthetic construct
agtagtgacgttggtggttataactat

SEQ ID NO: 11119 - DNA, 27 bp, Artificial Sequence
  Synthetic construct
agcagtgacgttggtgcttataagtat

SEQ ID NO: 11120 - DNA, 27 bp, Artificial Sequence
  Synthetic construct
agcagtgacgttggtgcttataactat

SEQ ID NO: 11121 - DNA, 27 bp, Artificial Sequence
  Synthetic construct
agtagtgacgttggtgcttataactat

SEQ ID NO: 11122 - DNA, 18 bp, Artificial Sequence
  Synthetic construct
cagggcattgccaactat

SEQ ID NO: 11123 - DNA, 21 bp, Artificial Sequence
  Synthetic construct
cagagtgttagcacctcctac

SEQ ID NO: 11124 - DNA, 36 bp, Artificial Sequence
  Synthetic construct
cagagtgttttatacagctccaacaataggcattac

SEQ ID NO: 11125 - DNA, 21 bp, Artificial Sequence
  Synthetic construct
cagagtcttaccaccaactac

SEQ ID NO: 11126 - DNA, 21 bp, Artificial Sequence
  Synthetic construct
caggctattagtagcagtaag

SEQ ID NO: 11127 - DNA, 18 bp, Artificial Sequence
  Synthetic construct
cagagtgttagcagctac

SEQ ID NO: 11128 - DNA, 18 bp, Artificial Sequence
  Synthetic construct
agcctcagaagctattat

SEQ ID NO: 11129 - DNA, 18 bp, Artificial Sequence
  Synthetic construct
aacattggaactaaaagt

SEQ ID NO: 11130 - DNA, 18 bp, Artificial Sequence
  Synthetic construct
cagagtgttagtagcaac

SEQ ID NO: 11131 - DNA, 24 bp, Artificial Sequence
  Synthetic construct
agctccaacatcggtactaaatat

SEQ ID NO: 11132 - DNA, 36 bp, Artificial Sequence
  Synthetic construct
cagagcctcttggatagtgatgatggaaacacctat

SEQ ID NO: 11133 - DNA, 27 bp, Artificial Sequence
  Synthetic construct
agcagtgatgttggtggttataactat

SEQ ID NO: 11134 - DNA, 18 bp, Artificial Sequence
  Synthetic construct
gaattgccagaccaattt

SEQ ID NO: 11135 - DNA, 27 bp, Artificial Sequence
  Synthetic construct
agcagtgacgttggtgggtataactat

SEQ ID NO: 11136 - DNA, 24 bp, Artificial Sequence
  Synthetic construct
agcggcagcattaccagcagcttt

SEQ ID NO: 11137 - DNA, 18 bp, Artificial Sequence
  Synthetic construct
cagggctttagtaattct

SEQ ID NO: 11138 - DNA, 18 bp, Artificial Sequence
  Synthetic construct
cagggcattaacattgat

SEQ ID NO: 11139 - DNA, 18 bp, Artificial Sequence
  Synthetic construct
cagagtattagtagttgg

SEQ ID NO: 11140 - DNA, 36 bp, Artificial Sequence
  Synthetic construct
cagagtgtcttatacagctccaacaataagaactac

SEQ ID NO: 11141 - DNA, 21 bp, Artificial Sequence
  Synthetic construct
cagagtgttaacagtaactat

SEQ ID NO: 11142 - DNA, 18 bp, Artificial Sequence
  Synthetic construct
cagagtattggtacttgg

SEQ ID NO: 11143 - DNA, 18 bp, Artificial Sequence
  Synthetic construct
gtgttggcaaaaaaatat

SEQ ID NO: 11144 - DNA, 18 bp, Artificial Sequence
  Synthetic construct
agaatggggactaggctt

SEQ ID NO: 11145 - DNA, 21 bp, Artificial Sequence
  Synthetic construct
cagagtgtgagcaacaactac

SEQ ID NO: 11146 - DNA, 18 bp, Artificial Sequence
  Synthetic construct
cagagtattaggagtgac

SEQ ID NO: 11147 - DNA, 18 bp, Artificial Sequence
  Synthetic construct
caggccattagcaatgat

SEQ ID NO: 11148 - DNA, 21 bp, Artificial Sequence
  Synthetic construct
cagagtattagtggtacctac

SEQ ID NO: 11149 - DNA, 18 bp, Artificial Sequence
  Synthetic construct
cagagtattagtacctgg

SEQ ID NO: 11150 - DNA, 24 bp, Artificial Sequence
  Synthetic construct
agttccaacatcggaagtaacgct

SEQ ID NO: 11151 - DNA, 18 bp, Artificial Sequence
  Synthetic construct
gtactggcaaaaaaacat

SEQ ID NO: 11152 - DNA, 18 bp, Artificial Sequence
  Synthetic construct
gctttgccaaagcaatat

SEQ ID NO: 11153 - DNA, 27 bp, Artificial Sequence
  Synthetic construct
agcagtgacgttggtgactataagtat

SEQ ID NO: 11154 - DNA, 18 bp, Artificial Sequence
  Synthetic construct
cagagtattaatagttgg

SEQ ID NO: 11155 - DNA, 27 bp, Artificial Sequence
  Synthetic construct
ggctccaacatcggggctcctcatgat

SEQ ID NO: 11156 - DNA, 33 bp, Artificial Sequence
  Synthetic construct
cagagcctcctggaagtaaatggaaacacctat

SEQ ID NO: 11157 - DNA, 21 bp, Artificial Sequence
  Synthetic construct
cggagtgtttacagcaactac

SEQ ID NO: 11158 - DNA, 24 bp, Artificial Sequence
  Synthetic construct
agtggcagcattgccagcaactat

SEQ ID NO: 11159 - DNA, 18 bp, Artificial Sequence
  Synthetic construct
cagagtcttagtgactgg

SEQ ID NO: 11160 - DNA, 18 bp, Artificial Sequence
  Synthetic construct
cagagtattagtgtctgg

SEQ ID NO: 11161 - DNA, 18 bp, Artificial Sequence
  Synthetic construct
gaattgggggataaattt

SEQ ID NO: 11162 - DNA, 18 bp, Artificial Sequence
  Synthetic construct
gtgagtgttaacagcaac

SEQ ID NO: 11163 - DNA, 21 bp, Artificial Sequence
  Synthetic construct
cacactgttaccgccgactac

SEQ ID NO: 11164 - DNA, 36 bp, Artificial Sequence
  Synthetic construct
cagagagtctccgagggcgccaacaattacaaatac

SEQ ID NO: 11165 - DNA, 33 bp, Artificial Sequence
  Synthetic construct
cacagcctcctccaccatgataggaaaaccttc

SEQ ID NO: 11166 - DNA, 18 bp, Artificial Sequence
  Synthetic construct
cagggcattagcacctat

SEQ ID NO: 11167 - DNA, 21 bp, Artificial Sequence
  Synthetic construct
cagagtattaacagcaactac

SEQ ID NO: 11168 - DNA, 18 bp, Artificial Sequence
  Synthetic construct
cagagtgttggcggcaac

SEQ ID NO: 11169 - DNA, 24 bp, Artificial Sequence
  Synthetic construct
aggtcccacttcgccataaatttt

SEQ ID NO: 11170 - DNA, 18 bp, Artificial Sequence
  Synthetic construct
cagaccatcgctacttct

SEQ ID NO: 11171 - DNA, 27 bp, Artificial Sequence
  Synthetic construct
tctgactcagtctctacttcttactac

SEQ ID NO: 11172 - DNA, 21 bp, Artificial Sequence
  Synthetic construct
cagagtgttcgcagcacctac

SEQ ID NO: 11173 - DNA, 21 bp, Artificial Sequence
  Synthetic construct
cagagtattagcagcagttat

SEQ ID NO: 11174 - DNA, 18 bp, Artificial Sequence
  Synthetic construct
cagagtattagtgactgg

SEQ ID NO: 11175 - DNA, 21 bp, Artificial Sequence
  Synthetic construct
cagagtgtttctaacgactac

SEQ ID NO: 11176 - DNA, 18 bp, Artificial Sequence
  Synthetic construct
cagagcattggtagtaac

SEQ ID NO: 11177 - DNA, 18 bp, Artificial Sequence
  Synthetic construct
cagagtgttggcatctac

SEQ ID NO: 11178 - DNA, 18 bp, Artificial Sequence
  Synthetic construct
cagggcattagaaatgat

SEQ ID NO: 11179 - DNA, 24 bp, Artificial Sequence
  Synthetic construct
agtggcagcataaccagcgcctat

SEQ ID NO: 11180 - DNA, 18 bp, Artificial Sequence
  Synthetic construct
cagagtgtgagcagcagc

SEQ ID NO: 11181 - DNA, 18 bp, Artificial Sequence
  Synthetic construct
aacattagaagtaagagt

SEQ ID NO: 11182 - DNA, 27 bp, Artificial Sequence
  Synthetic construct
agcagtgatgttggtggttataattct

SEQ ID NO: 11183 - DNA, 36 bp, Artificial Sequence
  Synthetic construct
cagagtgttttatccagctccaacaataaggactac

SEQ ID NO: 11184 - DNA, 18 bp, Artificial Sequence
  Synthetic construct
cagaccgtaaccaggttt

SEQ ID NO: 11185 - DNA, 18 bp, Artificial Sequence
  Synthetic construct
cggcctgttagcagcaac

SEQ ID NO: 11186 - DNA, 18 bp, Artificial Sequence
  Synthetic construct
cagggcattggaaatgat

SEQ ID NO: 11187 - DNA, 33 bp, Artificial Sequence
  Synthetic construct
cagagcctcctgcatagtcatggatacaactat

SEQ ID NO: 11188 - DNA, 6 bp, Artificial Sequence
  Synthetic construct
agactc

SEQ ID NO: 11189 - DNA, 18 bp, Artificial Sequence
  Synthetic construct
cagagtgttagcagttcc

SEQ ID NO: 11190 - DNA, 18 bp, Artificial Sequence
  Synthetic construct
cagggcattagcaattat

SEQ ID NO: 11191 - DNA, 18 bp, Artificial Sequence
  Synthetic construct
cagaacatttacaattat

SEQ ID NO: 11192 - DNA, 18 bp, Artificial Sequence
  Synthetic construct
agcctcagaaattattat

SEQ ID NO: 11193 - DNA, 15 bp, Artificial Sequence
  Synthetic construct
cagagtgttaacaac

SEQ ID NO: 11194 - DNA, 24 bp, Artificial Sequence
  Synthetic construct
agctccaacatcggatttaattct

SEQ ID NO: 11195 - DNA, 18 bp, Artificial Sequence
  Synthetic construct
aacattggaagtaaaact

SEQ ID NO: 11196 - DNA, 24 bp, Artificial Sequence
  Synthetic construct
agctcaaacatcggaagaaaccct

SEQ ID NO: 11197 - DNA, 9 bp, Artificial Sequence
  Synthetic construct
agcctcaga

SEQ ID NO: 11198 - DNA, 18 bp, Artificial Sequence
  Synthetic construct
cagagtattgatagctgg

SEQ ID NO: 11199 - DNA, 18 bp, Artificial Sequence
  Synthetic construct
aacattggaagtagaagt

SEQ ID NO: 11200 - DNA, 18 bp, Artificial Sequence
  Synthetic construct
aacattgggagtcaaagt

SEQ ID NO: 11201 - DNA, 21 bp, Artificial Sequence
  Synthetic construct
agtgggcacagcagctacgcc

SEQ ID NO: 11202 - DNA, 18 bp, Artificial Sequence
  Synthetic construct
cagaccattactaggtct

SEQ ID NO: 11203 - DNA, 18 bp, Artificial Sequence
  Synthetic construct
gcattgccaaatcaacat

SEQ ID NO: 11204 - DNA, 18 bp, Artificial Sequence
  Synthetic construct
cagggcattagaaatgac

SEQ ID NO: 11205 - DNA, 18 bp, Artificial Sequence
  Synthetic construct
cagagtgttaggaattac

SEQ ID NO: 11206 - DNA, 18 bp, Artificial Sequence
  Synthetic construct
cagagtgttaacaccgac

SEQ ID NO: 11207 - DNA, 18 bp, Artificial Sequence
  Synthetic construct
agcctcagaagctattct

SEQ ID NO: 11208 - DNA, 24 bp, Artificial Sequence
  Synthetic construct
agtggcagcattgccaacaactat

SEQ ID NO: 11209 - DNA, 18 bp, Artificial Sequence
  Synthetic construct
agcctcgaaagctattat

SEQ ID NO: 11210 - DNA, 18 bp, Artificial Sequence
  Synthetic construct
aaattgggggataaatat

SEQ ID NO: 11211 - DNA, 18 bp, Artificial Sequence
  Synthetic construct
caaagtatcagtaactgg

SEQ ID NO: 11212 - DNA, 18 bp, Artificial Sequence
  Synthetic construct
caaagtgttggcacctac

SEQ ID NO: 11213 - DNA, 18 bp, Artificial Sequence
  Synthetic construct
cgggacattaggagttat

SEQ ID NO: 11214 - DNA, 18 bp, Artificial Sequence
  Synthetic construct
cagagtgtcagcagcgac

SEQ ID NO: 11215 - DNA, 18 bp, Artificial Sequence
  Synthetic construct
cagaatattggtaactgg

SEQ ID NO: 11216 - DNA, 18 bp, Artificial Sequence
  Synthetic construct
cagagcattggaagctgg

SEQ ID NO: 11217 - DNA, 18 bp, Artificial Sequence
  Synthetic construct
cagagtattggcacgtgg

SEQ ID NO: 11218 - DNA, 24 bp, Artificial Sequence
  Synthetic construct
agctccaacgtcggaagtaatact

SEQ ID NO: 11219 - DNA, 18 bp, Artificial Sequence
  Synthetic construct
cagagtgtttcccacaac

SEQ ID NO: 11220 - DNA, 18 bp, Artificial Sequence
  Synthetic construct
cagagtgttggtatctgg

SEQ ID NO: 11221 - DNA, 36 bp, Artificial Sequence
  Synthetic construct
cagagtgttttcttcagctccaacaataggaactac

SEQ ID NO: 11222 - DNA, 18 bp, Artificial Sequence
  Synthetic construct
ttcggcagcagttcttat

SEQ ID NO: 11223 - DNA, 27 bp, Artificial Sequence
  Synthetic construct
agcagtgacgtcggttattataactat

SEQ ID NO: 11224 - DNA, 18 bp, Artificial Sequence
  Synthetic construct
cagagtgtcagcagcaac

SEQ ID NO: 11225 - DNA, 18 bp, Artificial Sequence
  Synthetic construct
tacattgaaagtaaaagt

SEQ ID NO: 11226 - DNA, 18 bp, Artificial Sequence
  Synthetic construct
cagaatgttgacagttat

SEQ ID NO: 11227 - DNA, 18 bp, Artificial Sequence
  Synthetic construct
cagagtgttggcagcaat

SEQ ID NO: 11228 - DNA, 24 bp, Artificial Sequence
  Synthetic construct
aactccaacattggatataattct

SEQ ID NO: 11229 - DNA, 27 bp, Artificial Sequence
  Synthetic construct
aacagtgatgttgggaattataacctt

SEQ ID NO: 11230 - DNA, 24 bp, Artificial Sequence
  Synthetic construct
aactccaacattggaaataattat

SEQ ID NO: 11231 - DNA, 18 bp, Artificial Sequence
  Synthetic construct
aacatcgaaactaaacct

SEQ ID NO: 11232 - DNA, 18 bp, Artificial Sequence
  Synthetic construct
cagagcattggcacctat

SEQ ID NO: 11233 - DNA, 21 bp, Artificial Sequence
  Synthetic construct
cagcatgttcgcacgaccatg

SEQ ID NO: 11234 - DNA, 18 bp, Artificial Sequence
  Synthetic construct
cggagtgttagtggctgg

SEQ ID NO: 11235 - DNA, 27 bp, Artificial Sequence
  Synthetic construct
agcagtgacgttgatgattataagttt

SEQ ID NO: 11236 - DNA, 21 bp, Artificial Sequence
  Synthetic construct
agtgggcacagtagctacatc

SEQ ID NO: 11237 - DNA, 36 bp, Artificial Sequence
  Synthetic construct
cagagtgtcttatatggctccagcaataagaactac

SEQ ID NO: 11238 - DNA, 18 bp, Artificial Sequence
  Synthetic construct
cagagtattagttcctgg

SEQ ID NO: 11239 - DNA, 18 bp, Artificial Sequence
  Synthetic construct
caggacattagcaattat

SEQ ID NO: 11240 - DNA, 18 bp, Artificial Sequence
  Synthetic construct
cagagtattagtgcctgg

SEQ ID NO: 11241 - DNA, 18 bp, Artificial Sequence
  Synthetic construct
cagagtattagaagctac

SEQ ID NO: 11242 - DNA, 27 bp, Artificial Sequence
  Synthetic construct
agttccaacatcggggcagcttatgat

SEQ ID NO: 11243 - DNA, 18 bp, Artificial Sequence
  Synthetic construct
ctggacatcagcaacttt

SEQ ID NO: 11244 - DNA, 18 bp, Artificial Sequence
  Synthetic construct
cacagtattagttcgtgg

SEQ ID NO: 11245 - DNA, 33 bp, Artificial Sequence
  Synthetic construct
caaagtgtcgttcgcagtgatgggatcacctac

SEQ ID NO: 11246 - DNA, 21 bp, Artificial Sequence
  Synthetic construct
cagagtgttggtagcgactac

SEQ ID NO: 11247 - DNA, 21 bp, Artificial Sequence
  Synthetic construct
accggtgacattggaggtctt

SEQ ID NO: 11248 - DNA, 36 bp, Artificial Sequence
  Synthetic construct
cacagtgtcttatctaatttgaataataaggattac

SEQ ID NO: 11249 - DNA, 18 bp, Artificial Sequence
  Synthetic construct
cagagtattactagctgg

SEQ ID NO: 11250 - DNA, 18 bp, Artificial Sequence
  Synthetic construct
cagagtgtcggttcctcc

SEQ ID NO: 11251 - DNA, 18 bp, Artificial Sequence
  Synthetic construct
cggagtatcagcaccaac

SEQ ID NO: 11252 - DNA, 18 bp, Artificial Sequence
  Synthetic construct
cagggcattagcaattct

SEQ ID NO: 11253 - DNA, 18 bp, Artificial Sequence
  Synthetic construct
gcattgccaaagaaattt

SEQ ID NO: 11254 - DNA, 18 bp, Artificial Sequence
  Synthetic construct
caggacattaagaactat

SEQ ID NO: 11255 - DNA, 21 bp, Artificial Sequence
  Synthetic construct
cagagtgtaaatggcaactac

SEQ ID NO: 11256 - DNA, 18 bp, Artificial Sequence
  Synthetic construct
cagagcattggtattagc

SEQ ID NO: 11257 - DNA, 18 bp, Artificial Sequence
  Synthetic construct
cagggtattagcagctgg

SEQ ID NO: 11258 - DNA, 18 bp, Artificial Sequence
  Synthetic construct
cagaacattaacagcaat

SEQ ID NO: 11259 - DNA, 36 bp, Artificial Sequence
  Synthetic construct
cagagtgttttatacaactccaacaataagaactac

SEQ ID NO: 11260 - DNA, 18 bp, Artificial Sequence
  Synthetic construct
gtattgccaaagcaatat

SEQ ID NO: 11261 - DNA, 18 bp, Artificial Sequence
  Synthetic construct
aatttgggggacaaatat

SEQ ID NO: 11262 - DNA, 18 bp, Artificial Sequence
  Synthetic construct
agcctcagaagttatttt

SEQ ID NO: 11263 - DNA, 18 bp, Artificial Sequence
  Synthetic construct
cacgacattgacaactat

SEQ ID NO: 11264 - DNA, 18 bp, Artificial Sequence
  Synthetic construct
caggccattagccataat

SEQ ID NO: 11265 - DNA, 33 bp, Artificial Sequence
  Synthetic construct
cagagcctcctgcatagtgatggatacacctat

SEQ ID NO: 11266 - DNA, 36 bp, Artificial Sequence
  Synthetic construct
cagagtgttttatacagctccgacaataaaaactac

SEQ ID NO: 11267 - DNA, 23 bp, Artificial Sequence
  Synthetic construct
agcagtgacgttggtggttataa

SEQ ID NO: 11268 - DNA, 27 bp, Artificial Sequence
  Synthetic construct
agcagtgatgttgggacttatgacctt

SEQ ID NO: 11269 - DNA, 27 bp, Artificial Sequence
  Synthetic construct
agcagtgacgttggtggttataattct

SEQ ID NO: 11270 - DNA, 21 bp, Artificial Sequence
  Synthetic construct
cagagtgttcccagcagctat

SEQ ID NO: 11271 - DNA, 18 bp, Artificial Sequence
  Synthetic construct
cagagaattagtagctgg

SEQ ID NO: 11272 - DNA, 18 bp, Artificial Sequence
  Synthetic construct
cagagcattggtagttac

SEQ ID NO: 11273 - DNA, 21 bp, Artificial Sequence
  Synthetic construct
cagagtgttagcagcaactcc

SEQ ID NO: 11274 - DNA, 36 bp, Artificial Sequence
  Synthetic construct
cagagtgttttatacacttccaacaataagaactac

SEQ ID NO: 11275 - DNA, 27 bp, Artificial Sequence
  Synthetic construct
tctggctcagtctctactagtgactac

SEQ ID NO: 11276 - DNA, 33 bp, Artificial Sequence
  Synthetic construct
caaagcctcgtgtccagtaatgggaacacctac

SEQ ID NO: 11277 - DNA, 27 bp, Artificial Sequence
  Synthetic construct
tctggctcagtctctactagttacttc

SEQ ID NO: 11278 - DNA, 18 bp, Artificial Sequence
  Synthetic construct
gtactggcaaaaaaatat

SEQ ID NO: 11279 - DNA, 33 bp, Artificial Sequence
  Synthetic construct
cagagcctcctgcatagtaatggatacaactat

SEQ ID NO: 11280 - DNA, 18 bp, Artificial Sequence
  Synthetic construct
caggacattagcaactat

SEQ ID NO: 11281 - DNA, 18 bp, Artificial Sequence
  Synthetic construct
cagagcattagtacctat

SEQ ID NO: 11282 - DNA, 18 bp, Artificial Sequence
  Synthetic construct
cagagcgttaacaactat

SEQ ID NO: 11283 - DNA, 33 bp, Artificial Sequence
  Synthetic construct
caaagcctcgttcacactgatggctacacctac

SEQ ID NO: 11284 - DNA, 18 bp, Artificial Sequence
  Synthetic construct
gacattgaaactagaagt

SEQ ID NO: 11285 - DNA, 18 bp, Artificial Sequence
  Synthetic construct
cagactattaatacttgg

SEQ ID NO: 11286 - DNA, 18 bp, Artificial Sequence
  Synthetic construct
gagagtgttagcaaccac

SEQ ID NO: 11287 - DNA, 36 bp, Artificial Sequence
  Synthetic construct
cagaatgttttatacagctccaacaataagaactac

SEQ ID NO: 11288 - DNA, 18 bp, Artificial Sequence
  Synthetic construct
aacattggaaggaaaagt

SEQ ID NO: 11289 - DNA, 18 bp, Artificial Sequence
  Synthetic construct
caaagcattagcggctat

SEQ ID NO: 11290 - DNA, 24 bp, Artificial Sequence
  Synthetic construct
agtggcagcattgccagcagctat

SEQ ID NO: 11291 - DNA, 27 bp, Artificial Sequence
  Synthetic construct
agtggcttcagtgttggggacttctgg

SEQ ID NO: 11292 - DNA, 24 bp, Artificial Sequence
  Synthetic construct
aagtccaacatcggaagtaatact

SEQ ID NO: 11293 - DNA, 18 bp, Artificial Sequence
  Synthetic construct
cagggtattggcagttat

SEQ ID NO: 11294 - DNA, 21 bp, Artificial Sequence
  Synthetic construct
cagagtgttcgcagtagctac

SEQ ID NO: 11295 - DNA, 24 bp, Artificial Sequence
  Synthetic construct
agctccaacattgggaataattat

SEQ ID NO: 11296 - DNA, 18 bp, Artificial Sequence
  Synthetic construct
cgtggtattaacgatttg

SEQ ID NO: 11297 - DNA, 30 bp, Artificial Sequence
  Synthetic construct
cagagtgtctcatataacagtaagaattac

SEQ ID NO: 11298 - DNA, 18 bp, Artificial Sequence
  Synthetic construct
aacattggaactaagagt

SEQ ID NO: 11299 - DNA, 27 bp, Artificial Sequence
  Synthetic construct
agcagtgatgttggtgcttatgactct

SEQ ID NO: 11300 - DNA, 18 bp, Artificial Sequence
  Synthetic construct
cagagtattgatagttgg

SEQ ID NO: 11301 - DNA, 18 bp, Artificial Sequence
  Synthetic construct
cagagtattaataactgg

SEQ ID NO: 11302 - DNA, 33 bp, Artificial Sequence
  Synthetic construct
caaagtctcgtgtacagcgatggaaacacctac

SEQ ID NO: 11303 - DNA, 18 bp, Artificial Sequence
  Synthetic construct
cagagtattagtaactgg

SEQ ID NO: 11304 - DNA, 18 bp, Artificial Sequence
  Synthetic construct
caggacattggggatgat

SEQ ID NO: 11305 - DNA, 18 bp, Artificial Sequence
  Synthetic construct
gtgttgtcaaagcaatat

SEQ ID NO: 11306 - DNA, 27 bp, Artificial Sequence
  Synthetic construct
agttccaatctcgggccaggttatgat

SEQ ID NO: 11307 - DNA, 18 bp, Artificial Sequence
  Synthetic construct
cagagtgttagctactac

SEQ ID NO: 11308 - DNA, 18 bp, Artificial Sequence
  Synthetic construct
cagatcattaacagctat

SEQ ID NO: 11309 - DNA, 18 bp, Artificial Sequence
  Synthetic construct
cacagtgttagcagctac

SEQ ID NO: 11310 - DNA, 27 bp, Artificial Sequence
  Synthetic construct
agcagtgacgttggtggttataacttt

SEQ ID NO: 11311 - DNA, 18 bp, Artificial Sequence
  Synthetic construct
cagggcattagaagttat

SEQ ID NO: 11312 - DNA, 18 bp, Artificial Sequence
  Synthetic construct
cagagtattagcaacatc

SEQ ID NO: 11313 - DNA, 27 bp, Artificial Sequence
  Synthetic construct
agcagtgacgttggtgattatgacttt

SEQ ID NO: 11314 - DNA, 24 bp, Artificial Sequence
  Synthetic construct
agctccaacattggtaataattat

SEQ ID NO: 11315 - DNA, 18 bp, Artificial Sequence
  Synthetic construct
cagggtattagcagttgg

SEQ ID NO: 11316 - DNA, 18 bp, Artificial Sequence
  Synthetic construct
aatgttggaagaaaaagt

SEQ ID NO: 11317 - DNA, 18 bp, Artificial Sequence
  Synthetic construct
cagggcattaactcttat

SEQ ID NO: 11318 - DNA, 18 bp, Artificial Sequence
  Synthetic construct
cagagtgttaggggcagc

SEQ ID NO: 11319 - DNA, 18 bp, Artificial Sequence
  Synthetic construct
cagggtattagtaattat

SEQ ID NO: 11320 - DNA, 24 bp, Artificial Sequence
  Synthetic construct
ggctccaacattgggaataattat

SEQ ID NO: 11321 - DNA, 18 bp, Artificial Sequence
  Synthetic construct
caaggagttagtagttat

SEQ ID NO: 11322 - DNA, 18 bp, Artificial Sequence
  Synthetic construct
aaactgggggataaattt

SEQ ID NO: 11323 - DNA, 18 bp, Artificial Sequence
  Synthetic construct
cagagcattagcacctat

SEQ ID NO: 11324 - DNA, 27 bp, Artificial Sequence
  Synthetic construct
agcagtgatgttgggacctatgacttt

SEQ ID NO: 11325 - DNA, 18 bp, Artificial Sequence
  Synthetic construct
cagagtattagcagctac

SEQ ID NO: 11326 - DNA, 36 bp, Artificial Sequence
  Synthetic construct
cagagtgttttatacagctccaacaataagaactcc

SEQ ID NO: 11327 - DNA, 18 bp, Artificial Sequence
  Synthetic construct
aaattgggggctagattt

SEQ ID NO: 11328 - DNA, 33 bp, Artificial Sequence
  Synthetic construct
caaaacctcgtacacagtgatggaagcacctac

SEQ ID NO: 11329 - DNA, 36 bp, Artificial Sequence
  Synthetic construct
cagagtcttttatacacctccaacaataagaactac

SEQ ID NO: 11330 - DNA, 21 bp, Artificial Sequence
  Synthetic construct
cagagtgtcagcagtgggttc

SEQ ID NO: 11331 - DNA, 27 bp, Artificial Sequence
  Synthetic construct
tctggctcagtctctacctattattat

SEQ ID NO: 11332 - DNA, 18 bp, Artificial Sequence
  Synthetic construct
cagagtattaggagttgg

SEQ ID NO: 11333 - DNA, 27 bp, Artificial Sequence
  Synthetic construct
actggagctgtcactagtggtcattat

SEQ ID NO: 11334 - DNA, 36 bp, Artificial Sequence
  Synthetic construct
cagagtgttttattcagtttaaataataagaattac

SEQ ID NO: 11335 - DNA, 18 bp, Artificial Sequence
  Synthetic construct
caggatattagcagctgg

SEQ ID NO: 11336 - DNA, 36 bp, Artificial Sequence
  Synthetic construct
cagagtgttttattcagctccaacaataagaactac

SEQ ID NO: 11337 - DNA, 27 bp, Artificial Sequence
  Synthetic construct
agcagtgacgttggtaattataattat

SEQ ID NO: 11338 - DNA, 18 bp, Artificial Sequence
  Synthetic construct
cagagaatagccaacaac

SEQ ID NO: 11339 - DNA, 27 bp, Artificial Sequence
  Synthetic construct
aacagtgacgttggtggttatgagtat

SEQ ID NO: 11340 - DNA, 24 bp, Artificial Sequence
  Synthetic construct
agctccaacatcggaagtaatact

SEQ ID NO: 11341 - DNA, 27 bp, Artificial Sequence
  Synthetic construct
agcagtgacgttggtgattatgactat

SEQ ID NO: 11342 - DNA, 21 bp, Artificial Sequence
  Synthetic construct
cagagtgttagtaacaattac

SEQ ID NO: 11343 - DNA, 18 bp, Artificial Sequence
  Synthetic construct
cagggcattagcgattat

SEQ ID NO: 11344 - DNA, 18 bp, Artificial Sequence
  Synthetic construct
aacattggaagtcggagt

SEQ ID NO: 11345 - DNA, 18 bp, Artificial Sequence
  Synthetic construct
cagagtgttagtaccaac

SEQ ID NO: 11346 - DNA, 18 bp, Artificial Sequence
  Synthetic construct
cagagtgttaggagccac

SEQ ID NO: 11347 - DNA, 27 bp, Artificial Sequence
  Synthetic construct
agcagtgatgtggggacttattccctt

SEQ ID NO: 11348 - DNA, 36 bp, Artificial Sequence
  Synthetic construct
ctgagtgttttttataagtacaacaataacaactac

SEQ ID NO: 11349 - DNA, 18 bp, Artificial Sequence
  Synthetic construct
aatgttgaagttaggagt

SEQ ID NO: 11350 - DNA, 18 bp, Artificial Sequence
  Synthetic construct
cacagcattatgaccaac

SEQ ID NO: 11351 - DNA, 18 bp, Artificial Sequence
  Synthetic construct
cagaatattgtcaatact

SEQ ID NO: 11352 - DNA, 18 bp, Artificial Sequence
  Synthetic construct
cagagtgttaacagcgac

SEQ ID NO: 11353 - DNA, 18 bp, Artificial Sequence
  Synthetic construct
cagagaatcagtagcaac

SEQ ID NO: 11354 - DNA, 18 bp, Artificial Sequence
  Synthetic construct
cagagcattaacagttat

SEQ ID NO: 11355 - DNA, 24 bp, Artificial Sequence
  Synthetic construct
agctccaacattgggaatcattat

SEQ ID NO: 11356 - DNA, 18 bp, Artificial Sequence
  Synthetic construct
caatacattggcagtttt

SEQ ID NO: 11357 - DNA, 18 bp, Artificial Sequence
  Synthetic construct
caggctattgacaatttt

SEQ ID NO: 11358 - DNA, 36 bp, Artificial Sequence
  Synthetic construct
caaagtgttttgttcgcgtccaacggtcggaatttc

SEQ ID NO: 11359 - DNA, 18 bp, Artificial Sequence
  Synthetic construct
gagagtattagtgactgg

SEQ ID NO: 11360 - DNA, 18 bp, Artificial Sequence
  Synthetic construct
aaattggaggatgaatat

SEQ ID NO: 11361 - DNA, 18 bp, Artificial Sequence
  Synthetic construct
gagagtgttagtagttac

SEQ ID NO: 11362 - DNA, 18 bp, Artificial Sequence
  Synthetic construct
cagagtattagcgcctcc

SEQ ID NO: 11363 - DNA, 33 bp, Artificial Sequence
  Synthetic construct
cggagtctcgttcacagtgatggggccacgtac

SEQ ID NO: 11364 - DNA, 18 bp, Artificial Sequence
  Synthetic construct
cagagcattagcaactat

SEQ ID NO: 11365 - DNA, 24 bp, Artificial Sequence
  Synthetic construct
agctccaacatcggtaacaatcct

SEQ ID NO: 11366 - DNA, 24 bp, Artificial Sequence
  Synthetic construct
agcaacaatgttggcaaccaagga

SEQ ID NO: 11367 - DNA, 18 bp, Artificial Sequence
  Synthetic construct
cagagtatttataactgg

SEQ ID NO: 11368 - DNA, 27 bp, Artificial Sequence
  Synthetic construct
agcagtgacattggtgcctatgactat

SEQ ID NO: 11369 - DNA, 18 bp, Artificial Sequence
  Synthetic construct
cagagtgttggcagcagc

SEQ ID NO: 11370 - DNA, 30 bp, Artificial Sequence
  Synthetic construct
aagagcctcctgcataatggagacaacctt

SEQ ID NO: 11371 - DNA, 18 bp, Artificial Sequence
  Synthetic construct
cagggtattagcaactgg

SEQ ID NO: 11372 - DNA, 27 bp, Artificial Sequence
  Synthetic construct
agcacttatgtcgatgcttttacctat

SEQ ID NO: 11373 - DNA, 18 bp, Artificial Sequence
  Synthetic construct
cagggcattagaaataat

SEQ ID NO: 11374 - DNA, 18 bp, Artificial Sequence
  Synthetic construct
caggatgttgattcttat

SEQ ID NO: 11375 - DNA, 36 bp, Artificial Sequence
  Synthetic construct
cagtctcttttatacagctccagccataagaacttc

SEQ ID NO: 11376 - DNA, 27 bp, Artificial Sequence
  Synthetic construct
agcagtgaccttagtgtctacaactct

SEQ ID NO: 11377 - DNA, 36 bp, Artificial Sequence
  Synthetic construct
cagagtgttttatacacctccaataataagaactat

SEQ ID NO: 11378 - DNA, 18 bp, Artificial Sequence
  Synthetic construct
cagggaattggtacttgg

SEQ ID NO: 11379 - DNA, 18 bp, Artificial Sequence
  Synthetic construct
cagagcattaggacctat

SEQ ID NO: 11380 - DNA, 18 bp, Artificial Sequence
  Synthetic construct
aacgttggaactcaaaat

SEQ ID NO: 11381 - DNA, 24 bp, Artificial Sequence
  Synthetic construct
agctccaacattggcaataactat

SEQ ID NO: 11382 - DNA, 21 bp, Artificial Sequence
  Synthetic construct
cagctttttagcggcagctat

SEQ ID NO: 11383 - DNA, 21 bp, Artificial Sequence
  Synthetic construct
cagagtgtcactaacgactat

SEQ ID NO: 11384 - DNA, 33 bp, Artificial Sequence; identical to SEQ ID NO: 1865
  Synthetic construct

SEQ ID NO: 11385 - DNA, 27 bp, Artificial Sequence
  Synthetic construct
aacagtgacgttggtggttataagtat

SEQ ID NO: 11386 - DNA, 21 bp, Artificial Sequence
  Synthetic construct
cagactattaactacaactat

SEQ ID NO: 11387 - DNA, 18 bp, Artificial Sequence
  Synthetic construct
cagtccattggcaatttt

SEQ ID NO: 11388 - DNA, 18 bp, Artificial Sequence
  Synthetic construct
cagacctttaacggcttt

SEQ ID NO: 11389 - DNA, 18 bp, Artificial Sequence
  Synthetic construct
aaacttggccgcagaagt

SEQ ID NO: 11390 - DNA, 24 bp, Artificial Sequence
  Synthetic construct
acctccaacattgggaataattat

SEQ ID NO: 11391 - DNA, 24 bp, Artificial Sequence
  Synthetic construct
agctccaatattgggaataattat

SEQ ID NO: 11392 - DNA, 36 bp, Artificial Sequence
  Synthetic construct
cagaatcttttatccagcttcaacagtgaaaactac

SEQ ID NO: 11393 - DNA, 18 bp, Artificial Sequence
  Synthetic construct
caagacataggtaacttt

SEQ ID NO: 11394 - DNA, 27 bp, Artificial Sequence
  Synthetic construct
agtagtgacagtagtgtttataactct

SEQ ID NO: 11395 - DNA, 21 bp, Artificial Sequence
  Synthetic construct
cagagtgtaagcggcaaccac

SEQ ID NO: 11396 - DNA, 21 bp, Artificial Sequence
  Synthetic construct
cagagtattagcgatttctac

SEQ ID NO: 11397 - DNA, 36 bp, Artificial Sequence
  Synthetic construct
gaaagtcttttatacagttcaaccaatcgtgactac

SEQ ID NO: 11398 - DNA, 18 bp, Artificial Sequence
  Synthetic construct
cagaccattaataactat

SEQ ID NO: 11399 - DNA, 18 bp, Artificial Sequence
  Synthetic construct
cagggcattagcgattac

SEQ ID NO: 11400 - DNA, 24 bp, Artificial Sequence
  Synthetic construct
agctccaacattgggatttatcct

SEQ ID NO: 11401 - DNA, 27 bp, Artificial Sequence
  Synthetic construct
ggcagtgacgttggtggttatgactat

SEQ ID NO: 11402 - DNA, 18 bp, Artificial Sequence
  Synthetic construct
cagggccttagtggtgaa

SEQ ID NO: 11403 - DNA, 24 bp, Artificial Sequence
  Synthetic construct
agctccaacatcggacgaaattat

SEQ ID NO: 11404 - DNA, 33 bp, Artificial Sequence
  Synthetic construct
cagagcctcctccatagtaatggaaagacctat

SEQ ID NO: 11405 - DNA, 24 bp, Artificial Sequence
  Synthetic construct
agctccaacattgggcataattat

SEQ ID NO: 11406 - DNA, 21 bp, Artificial Sequence
  Synthetic construct
cagagtgttagcagcgaccac

SEQ ID NO: 11407 - DNA, 18 bp, Artificial Sequence
  Synthetic construct
caagacattgatgatgat

SEQ ID NO: 11408 - DNA, 27 bp, Artificial Sequence
  Synthetic construct
agctccaacatcggggcaaattatgat

SEQ ID NO: 11409 - DNA, 18 bp, Artificial Sequence
  Synthetic construct
caggtcattaccaattct

SEQ ID NO: 11410 - DNA, 18 bp, Artificial Sequence
  Synthetic construct
cagagcattagaaatgat

SEQ ID NO: 11411 - DNA, 18 bp, Artificial Sequence
  Synthetic construct
acattgtcaaagcaatat

SEQ ID NO: 11412 - DNA, 18 bp, Artificial Sequence
  Synthetic construct
caggaaatagaacatcat

SEQ ID NO: 11413 - DNA, 18 bp, Artificial Sequence
  Synthetic construct
cagggtattagcagcttt

SEQ ID NO: 11414 - DNA, 36 bp, Artificial Sequence
  Synthetic construct
cagagtattttaaacagtgccagcaataaggaccac

SEQ ID NO: 11415 - DNA, 18 bp, Artificial Sequence
  Synthetic construct
aacattgtgagtaaaagt

SEQ ID NO: 11416 - DNA, 27 bp, Artificial Sequence
  Synthetic construct
agcagtgacgttggtgcttatagtttt

SEQ ID NO: 11417 - DNA, 18 bp, Artificial Sequence
  Synthetic construct
cagagtgtaagcagcaat

SEQ ID NO: 11418 - DNA, 18 bp, Artificial Sequence
  Synthetic construct
cagagcattagcttctat

SEQ ID NO: 11419 - DNA, 18 bp, Artificial Sequence
  Synthetic construct
cagggtgttggcagctac

SEQ ID NO: 11420 - DNA, 27 bp, Artificial Sequence
  Synthetic construct
agttccaacatcgggggcaatcatgat

SEQ ID NO: 11421 - DNA, 27 bp, Artificial Sequence
  Synthetic construct
agcactgacgttggtggttataactat

SEQ ID NO: 11422 - DNA, 18 bp, Artificial Sequence
  Synthetic construct
agcctccgagaacatgct

SEQ ID NO: 11423 - DNA, 18 bp, Artificial Sequence
  Synthetic construct
cacagtattagcagctac

SEQ ID NO: 11424 - DNA, 33 bp, Artificial Sequence
  Synthetic construct
caaggcctcgtacacagtgatggaaacacctac

SEQ ID NO: 11425 - DNA, 18 bp, Artificial Sequence
  Synthetic construct
cagagcattggtaatagc

SEQ ID NO: 11426 - DNA, 21 bp, Artificial Sequence
  Synthetic construct
cagagtgttaacagtaactac

SEQ ID NO: 11427 - DNA, 18 bp, Artificial Sequence
  Synthetic construct
cagtccattaactactat

SEQ ID NO: 11428 - DNA, 21 bp, Artificial Sequence
  Synthetic construct
cagactgttagcaacacctcc

SEQ ID NO: 11429 - DNA, 18 bp, Artificial Sequence
  Synthetic construct
caggccataagcaattcc

SEQ ID NO: 11430 - DNA, 27 bp, Artificial Sequence
  Synthetic construct
agcagtgacgttggtgattataactat

SEQ ID NO: 11431 - DNA, 27 bp, Artificial Sequence
  Synthetic construct
agtgacatcaatgttggtagccacaac

SEQ ID NO: 11432 - DNA, 18 bp, Artificial Sequence
  Synthetic construct
caggacattaccaaatat

SEQ ID NO: 11433 - DNA, 18 bp, Artificial Sequence
  Synthetic construct
cagggtgctcacaaatgg

SEQ ID NO: 11434 - DNA, 18 bp, Artificial Sequence
  Synthetic construct
cagagtgtcagaaactcc

SEQ ID NO: 11435 - DNA, 24 bp, Artificial Sequence
  Synthetic construct
atctccaacattgggagaaattat

SEQ ID NO: 11436 - DNA, 18 bp, Artificial Sequence
  Synthetic construct
tttggtggttataactat

SEQ ID NO: 11437 - DNA, 36 bp, Artificial Sequence
  Synthetic construct
cagagtgttttatacagctcctacaataagagctac

SEQ ID NO: 11438 - DNA, 24 bp, Artificial Sequence
  Synthetic construct
agctccaacctcggaagtaacact

SEQ ID NO: 11439 - DNA, 18 bp, Artificial Sequence
  Synthetic construct
cagaacattggcaggtat

SEQ ID NO: 11440 - DNA, 18 bp, Artificial Sequence
  Synthetic construct
aacattatatctaaaagt

SEQ ID NO: 11441 - DNA, 24 bp, Artificial Sequence
  Synthetic construct
atctccaacattgggactaattat

SEQ ID NO: 11442 - DNA, 18 bp, Artificial Sequence
  Synthetic construct
cagggcaatggctactct

SEQ ID NO: 11443 - DNA, 21 bp, Artificial Sequence
  Synthetic construct
cagagtgttagcaacaactac

SEQ ID NO: 11444 - DNA, 33 bp, Artificial Sequence
  Synthetic construct
cagagtctccgccatagtaaaggaatcactttt

SEQ ID NO: 11445 - DNA, 18 bp, Artificial Sequence
  Synthetic construct
caaaacataaccaaccat

SEQ ID NO: 11446 - DNA, 27 bp, Artificial Sequence
  Synthetic construct
agcagtgacgttggtacttataactat

SEQ ID NO: 11447 - DNA, 33 bp, Artificial Sequence
  Synthetic construct
cagagcctcctgcatactaatggatacaactat

SEQ ID NO: 11448 - DNA, 18 bp, Artificial Sequence
  Synthetic construct
catgacattggcaaccat

SEQ ID NO: 11449 - DNA, 27 bp, Artificial Sequence
  Synthetic construct
aacactgatgttgggagttataacctt

SEQ ID NO: 11450 - DNA, 18 bp, Artificial Sequence
  Synthetic construct
cagagtattgccacttat

SEQ ID NO: 11451 - DNA, 36 bp, Artificial Sequence
  Synthetic construct
cagactattttattcaactccaacaataagaactac

SEQ ID NO: 11452 - DNA, 18 bp, Artificial Sequence
  Synthetic construct
cagagtgttagcagttac

SEQ ID NO: 11453 - DNA, 18 bp, Artificial Sequence
  Synthetic construct
cttcatattagcacttat

SEQ ID NO: 11454 - DNA, 18 bp, Artificial Sequence
  Synthetic construct
cagcccatcagtcagtat

SEQ ID NO: 11455 - DNA, 21 bp, Artificial Sequence
  Synthetic construct
agtgagcacgacacctatgcc

SEQ ID NO: 11456 - DNA, 27 bp, Artificial Sequence
  Synthetic construct
agctccaacatcggggcagattatgat

SEQ ID NO: 11457 - DNA, 18 bp, Artificial Sequence
  Synthetic construct
cagagtgttagcaccaac

SEQ ID NO: 11458 - DNA, 18 bp, Artificial Sequence
  Synthetic construct
cagagtgttaacacttac

SEQ ID NO: 11459 - DNA, 18 bp, Artificial Sequence
  Synthetic construct
cagggcattcgcagtgct

SEQ ID NO: 11460 - DNA, 27 bp, Artificial Sequence
  Synthetic construct
actggagcagtcaccagtggttactat

SEQ ID NO: 11461 - DNA, 18 bp, Artificial Sequence
  Synthetic construct
cagacaattagtagctgg

SEQ ID NO: 11462 - DNA, 21 bp, Artificial Sequence
  Synthetic construct
cagagtgttagaagcagctac

SEQ ID NO: 11463 - DNA, 18 bp, Artificial Sequence
  Synthetic construct
agtctcagaggctattat

SEQ ID NO: 11464 - DNA, 18 bp, Artificial Sequence
  Synthetic construct
cagaccattattaactat

SEQ ID NO: 11465 - DNA, 36 bp, Artificial Sequence
  Synthetic construct
cagagcctcttggatagtgatgatggaagcacctat

SEQ ID NO: 11466 - DNA, 18 bp, Artificial Sequence
  Synthetic construct
cagagcattagcagcttt

SEQ ID NO: 11467 - DNA, 18 bp, Artificial Sequence
  Synthetic construct
cagaccattgcaaagtct

SEQ ID NO: 11468 - DNA, 18 bp, Artificial Sequence
  Synthetic construct
cagagcatttacaactat

SEQ ID NO: 11469 - DNA, 27 bp, Artificial Sequence
  Synthetic construct
agcaatgattttgggacttataacctt

SEQ ID NO: 11470 - DNA, 18 bp, Artificial Sequence
  Synthetic construct
cagagtgttagcagctat

SEQ ID NO: 11471 - DNA, 18 bp, Artificial Sequence
  Synthetic construct
gaattgggggaaaaattt

SEQ ID NO: 11472 - DNA, 36 bp, Artificial Sequence
  Synthetic construct
cagagtcttttatacagctccgacaatatgaactac

SEQ ID NO: 11473 - DNA, 24 bp, Artificial Sequence
  Synthetic construct
agctccaacatcggagataatcct

SEQ ID NO: 11474 - DNA, 24 bp, Artificial Sequence
  Synthetic construct
acctccaatattggcaatcatttt

SEQ ID NO: 11475 - DNA, 18 bp, Artificial Sequence
  Synthetic construct
cagggcattaatagttat

SEQ ID NO: 11476 - DNA, 18 bp, Artificial Sequence
  Synthetic construct
cagagcattagcggctat

SEQ ID NO: 11477 - DNA, 27 bp, Artificial Sequence
  Synthetic construct
agctccaacatcggggcaggttttgat

SEQ ID NO: 11478 - DNA, 21 bp, Artificial Sequence
  Synthetic construct
caaagtgttagcagcaactac

SEQ ID NO: 11479 - DNA, 18 bp, Artificial Sequence
  Synthetic construct
cagagtattaatactagg

SEQ ID NO: 11480 - DNA, 18 bp, Artificial Sequence
  Synthetic construct
cagagcatatccacctat

SEQ ID NO: 11481 - DNA, 21 bp, Artificial Sequence
  Synthetic construct
cagactattatcagcaactat

SEQ ID NO: 11482 - DNA, 27 bp, Artificial Sequence
  Synthetic construct
agctccaatatcggggcgagttctggt

SEQ ID NO: 11483 - DNA, 18 bp, Artificial Sequence
  Synthetic construct
cagaacataaccaaccat

SEQ ID NO: 11484 - DNA, 18 bp, Artificial Sequence
  Synthetic construct
cagagtgtgagcagcaac

SEQ ID NO: 11485 - DNA, 33 bp, Artificial Sequence
  Synthetic construct
cacgccctcgttcacagtgatggagacacttac

SEQ ID NO: 11486 - DNA, 18 bp, Artificial Sequence
  Synthetic construct
cagagtgttgacagctac

SEQ ID NO: 11487 - DNA, 27 bp, Artificial Sequence
  Synthetic construct
agcgatgacgttggtgcttttgactat

SEQ ID NO: 11488 - DNA, 18 bp, Artificial Sequence
  Synthetic construct
aacattggatataaaagt

SEQ ID NO: 11489 - DNA, 36 bp, Artificial Sequence
  Synthetic construct
cagagtgttttaaacacctccaacaataagaactac

SEQ ID NO: 11490 - DNA, 21 bp, Artificial Sequence
  Synthetic construct
cagagtgtcgccggcggccac

SEQ ID NO: 11491 - DNA, 18 bp, Artificial Sequence
  Synthetic construct
aacattggaggtatacgt

SEQ ID NO: 11492 - DNA, 18 bp, Artificial Sequence
  Synthetic construct
cagggtattagtagttat

SEQ ID NO: 11493 - DNA, 18 bp, Artificial Sequence
  Synthetic construct
cagagcattagtgacaat

SEQ ID NO: 11494 - DNA, 18 bp, Artificial Sequence
  Synthetic construct
cagagaattgacaataaa

SEQ ID NO: 11495 - DNA, 27 bp, Artificial Sequence
  Synthetic construct
agcagtgatgttgggaattataacctt

SEQ ID NO: 11496 - DNA, 18 bp, Artificial Sequence
  Synthetic construct
aatattggaactaaagct

SEQ ID NO: 11497 - DNA, 18 bp, Artificial Sequence
  Synthetic construct
aatattgaaagtaagagt

SEQ ID NO: 11498 - DNA, 24 bp, Artificial Sequence
  Synthetic construct
agctccaacattgggaaaaattct

SEQ ID NO: 11499 - DNA, 33 bp, Artificial Sequence
  Synthetic construct
cagagcctcctgcatagtgatggaaagacctat

SEQ ID NO: 11500 - DNA, 24 bp, Artificial Sequence
  Synthetic construct
acctccaacatcggaagtaatact

SEQ ID NO: 11501 - DNA, 27 bp, Artificial Sequence
  Synthetic construct
agcagtgatgttggaagttataacctt

SEQ ID NO: 11502 - DNA, 27 bp, Artificial Sequence
  Synthetic construct
agcagtgacgttggtggttataactct

SEQ ID NO: 11503 - DNA, 24 bp, Artificial Sequence
  Synthetic construct
agctccaacatcggaattaatact

SEQ ID NO: 11504 - DNA, 18 bp, Artificial Sequence
  Synthetic construct
cagagcattagcagttct

SEQ ID NO: 11505 - DNA, 18 bp, Artificial Sequence
  Synthetic construct
gaattgccaaagcaatat

SEQ ID NO: 11506 - DNA, 18 bp, Artificial Sequence
  Synthetic construct
cagagtgttagtagtctc

SEQ ID NO: 11507 - DNA, 27 bp, Artificial Sequence
  Synthetic construct
agcggtgacgttggtggttttaacttt

SEQ ID NO: 11508 - DNA, 18 bp, Artificial Sequence
  Synthetic construct
cagaatgtaagaagctac

SEQ ID NO: 11509 - DNA, 18 bp, Artificial Sequence
  Synthetic construct
ggattgccaaagcaatat

SEQ ID NO: 11510 - DNA, 21 bp, Artificial Sequence
  Synthetic construct
cagagggttgacaggaagtac

SEQ ID NO: 11511 - DNA, 18 bp, Artificial Sequence
  Synthetic construct
cgggccattgacaattat

SEQ ID NO: 11512 - DNA, 24 bp, Artificial Sequence
  Synthetic construct
aactccaacattgggaataattat

SEQ ID NO: 11513 - DNA, 18 bp, Artificial Sequence
  Synthetic construct
cagggcattgaaaatgat

SEQ ID NO: 11514 - DNA, 27 bp, Artificial Sequence
  Synthetic construct
agaagtgatattgggacttataacctt

SEQ ID NO: 11515 - DNA, 18 bp, Artificial Sequence
  Synthetic construct
tactttgaagttaaaagt

SEQ ID NO: 11516 - DNA, 18 bp, Artificial Sequence
  Synthetic construct
aatattggaggtaaaact

SEQ ID NO: 11517 - DNA, 21 bp, Artificial Sequence
  Synthetic construct
cagtatttttccagcaactac

SEQ ID NO: 11518 - DNA, 18 bp, Artificial Sequence
  Synthetic construct
gagaacattagaaactgg

SEQ ID NO: 11519 - DNA, 21 bp, Artificial Sequence
  Synthetic construct
cagagtcttagcagcgacttc

SEQ ID NO: 11520 - DNA, 21 bp, Artificial Sequence
  Synthetic construct
cagagtgttagcgagaccaat

SEQ ID NO: 11521 - DNA, 18 bp, Artificial Sequence
  Synthetic construct
accattggaggtgccact

SEQ ID NO: 11522 - DNA, 27 bp, Artificial Sequence
  Synthetic construct
agcaatgatattgggagttataatctt

SEQ ID NO: 11523 - DNA, 9 bp, Artificial Sequence
  Synthetic construct
ggtgcatcc

SEQ ID NO: 11524 - DNA, 9 bp, Artificial Sequence
  Synthetic construct
aaggcgtct

SEQ ID NO: 11525 - DNA, 9 bp, Artificial Sequence
  Synthetic construct
gaggtcagt

SEQ ID NO: 11526 - DNA, 9 bp, Artificial Sequence
  Synthetic construct
ggtgttacc

SEQ ID NO: 11527 - DNA, 9 bp, Artificial Sequence
  Synthetic construct
gatacaagc

SEQ ID NO: 11528 - DNA, 9 bp, Artificial Sequence
  Synthetic construct
gaagacagt

SEQ ID NO: 11529 - DNA, 9 bp, Artificial Sequence
  Synthetic construct
ggttcatct

SEQ ID NO: 11530 - DNA, 9 bp, Artificial Sequence
  Synthetic construct
aagacgtct

SEQ ID NO: 11531 - DNA, 9 bp, Artificial Sequence
  Synthetic construct
tgggcatct

SEQ ID NO: 11532 - DNA, 9 bp, Artificial Sequence
  Synthetic construct
aaagacaac

SEQ ID NO: 11533 - DNA, 9 bp, Artificial Sequence
  Synthetic construct
gatgcttcc

SEQ ID NO: 11534 - DNA, 9 bp, Artificial Sequence
  Synthetic construct
gatgtcagt

SEQ ID NO: 11535 - DNA, 9 bp, Artificial Sequence
  Synthetic construct
tgggcttct

SEQ ID NO: 11536 - DNA, 9 bp, Artificial Sequence
  Synthetic construct
ggtaacagg

SEQ ID NO: 11537 - DNA, 9 bp, Artificial Sequence
  Synthetic construct
gaggtcaat

SEQ ID NO: 11538 - DNA, 9 bp, Artificial Sequence
  Synthetic construct
ggtgaaaac

SEQ ID NO: 11539 - DNA, 9 bp, Artificial Sequence
  Synthetic construct
gcagataac

SEQ ID NO: 11540 - DNA, 9 bp, Artificial Sequence
  Synthetic construct
tgggcatcg

SEQ ID NO: 11541 - DNA, 9 bp, Artificial Sequence
  Synthetic construct
tatgcttcc

SEQ ID NO: 11542 - DNA, 9 bp, Artificial Sequence
  Synthetic construct
ggtatatcc

SEQ ID NO: 11543 - DNA, 9 bp, Artificial Sequence
  Synthetic construct
agtgcatcc

SEQ ID NO: 11544 - DNA, 9 bp, Artificial Sequence
  Synthetic construct
ggtgcatcg

SEQ ID NO: 11545 - DNA, 9 bp, Artificial Sequence
  Synthetic construct
gatgatagc

SEQ ID NO: 11546 - DNA, 9 bp, Artificial Sequence
  Synthetic construct
ggtaacaat

SEQ ID NO: 11547 - DNA, 9 bp, Artificial Sequence
  Synthetic construct
gctgcagtc

SEQ ID NO: 11548 - DNA, 9 bp, Artificial Sequence
  Synthetic construct
gagggcagt

SEQ ID NO: 11549 - DNA, 9 bp, Artificial Sequence
  Synthetic construct
gaagtttcc

SEQ ID NO: 11550 - DNA, 9 bp, Artificial Sequence
  Synthetic construct
gctgcatcc

SEQ ID NO: 11551 - DNA, 9 bp, Artificial Sequence
  Synthetic construct
aaagacgat

SEQ ID NO: 11552 - DNA, 9 bp, Artificial Sequence
  Synthetic construct
aggaataat

SEQ ID NO: 11553 - DNA, 9 bp, Artificial Sequence
  Synthetic construct
gaggtcact

SEQ ID NO: 11554 - DNA, 24 bp, Artificial Sequence
  Synthetic construct
gtgggcactggtgggattgtggga

SEQ ID NO: 11555 - DNA, 9 bp, Artificial Sequence
  Synthetic construct
gttgcatcc

SEQ ID NO: 11556 - DNA, 9 bp, Artificial Sequence
  Synthetic construct
aaggtttct

SEQ ID NO: 11557 - DNA, 9 bp, Artificial Sequence
  Synthetic construct
ggtatcacc

SEQ ID NO: 11558 - DNA, 9 bp, Artificial Sequence
  Synthetic construct
gatgcatcc

SEQ ID NO: 11559 - DNA, 21 bp, Artificial Sequence
  Synthetic construct
gttgatcctgacggcaattat

SEQ ID NO: 11560 - DNA, 9 bp, Artificial Sequence
  Synthetic construct
ggtaacagc

SEQ ID NO: 11561 - DNA, 9 bp, Artificial Sequence
  Synthetic construct
ggtgtatcc

SEQ ID NO: 11562 - DNA, 9 bp, Artificial Sequence
  Synthetic construct
cgtgcatcc

SEQ ID NO: 11563 - DNA, 9 bp, Artificial Sequence
  Synthetic construct
gatacatcc

SEQ ID NO: 11564 - DNA, 9 bp, Artificial Sequence
  Synthetic construct
gttacatcc

SEQ ID NO: 11565 - DNA, 9 bp, Artificial Sequence
  Synthetic construct
gctgaatcc

SEQ ID NO: 11566 - DNA, 9 bp, Artificial Sequence
  Synthetic construct
gctgcgtcc

SEQ ID NO: 11567 - DNA, 9 bp, Artificial Sequence
  Synthetic construct
gctgcatac

SEQ ID NO: 11568 - DNA, 9 bp, Artificial Sequence
  Synthetic construct
gatgcaacc

SEQ ID NO: 11569 - DNA, 9 bp, Artificial Sequence
  Synthetic construct
ggtgcctcc

SEQ ID NO: 11570 - DNA, 9 bp, Artificial Sequence
  Synthetic construct
gacgcttcc

SEQ ID NO: 11571 - DNA, 9 bp, Artificial Sequence
  Synthetic construct
gatgcgtcc

SEQ ID NO: 11572 - DNA, 9 bp, Artificial Sequence
  Synthetic construct
gatgtatcc

SEQ ID NO: 11573 - DNA, 9 bp, Artificial Sequence
  Synthetic construct
aaagacact

SEQ ID NO: 11574 - DNA, 9 bp, Artificial Sequence
  Synthetic construct
gatgacagt

SEQ ID NO: 11575 - DNA, 9 bp, Artificial Sequence
  Synthetic construct
gatgtcact

SEQ ID NO: 11576 - DNA, 9 bp, Artificial Sequence
  Synthetic construct
ggtgcatac

SEQ ID NO: 11577 - DNA, 9 bp, Artificial Sequence
  Synthetic construct
ggtaaaaac

SEQ ID NO: 11578 - DNA, 9 bp, Artificial Sequence
  Synthetic construct
cggaataat

SEQ ID NO: 11579 - DNA, 9 bp, Artificial Sequence
  Synthetic construct
acgctttcc

SEQ ID NO: 11580 - DNA, 9 bp, Artificial Sequence
  Synthetic construct
ggtgcctct

SEQ ID NO: 11581 - DNA, 9 bp, Artificial Sequence
  Synthetic construct
aaggacact

SEQ ID NO: 11582 - DNA, 9 bp, Artificial Sequence
  Synthetic construct
gaggataac

SEQ ID NO: 11583 - DNA, 9 bp, Artificial Sequence
  Synthetic construct
actgcatcc

SEQ ID NO: 11584 - DNA, 9 bp, Artificial Sequence
  Synthetic construct
gggaacgac

SEQ ID NO: 11585 - DNA, 9 bp, Artificial Sequence
  Synthetic construct
ggtgcgtcc

SEQ ID NO: 11586 - DNA, 9 bp, Artificial Sequence
  Synthetic construct
aaagacagt

SEQ ID NO: 11587 - DNA, 9 bp, Artificial Sequence
  Synthetic construct
aatgacagc

SEQ ID NO: 11588 - DNA, 9 bp, Artificial Sequence
  Synthetic construct
tctgcatcc

SEQ ID NO: 11589 - DNA, 9 bp, Artificial Sequence
  Synthetic construct
agggcgtct

SEQ ID NO: 11590 - DNA, 9 bp, Artificial Sequence
  Synthetic construct
tctgataat

SEQ ID NO: 11591 - DNA, 9 bp, Artificial Sequence
  Synthetic construct
caagacagt

SEQ ID NO: 11592 - DNA, 9 bp, Artificial Sequence
  Synthetic construct
caggcgtct

SEQ ID NO: 11593 - DNA, 9 bp, Artificial Sequence
  Synthetic construct
ggcaacaac

SEQ ID NO: 11594 - DNA, 9 bp, Artificial Sequence
  Synthetic construct
ttaacttct

SEQ ID NO: 11595 - DNA, 9 bp, Artificial Sequence
  Synthetic construct
ggtatttcc

SEQ ID NO: 11596 - DNA, 9 bp, Artificial Sequence
  Synthetic construct
aaggcatct

SEQ ID NO: 11597 - DNA, 9 bp, Artificial Sequence
  Synthetic construct
caagatacc

SEQ ID NO: 11598 - DNA, 9 bp, Artificial Sequence
  Synthetic construct
ggtacatcc

SEQ ID NO: 11599 - DNA, 9 bp, Artificial Sequence
  Synthetic construct
tgggcgtct

SEQ ID NO: 11600 - DNA, 9 bp, Artificial Sequence
  Synthetic construct
gaggttttt

SEQ ID NO: 11601 - DNA, 9 bp, Artificial Sequence
  Synthetic construct
agcaatgat

SEQ ID NO: 11602 - DNA, 9 bp, Artificial Sequence
  Synthetic construct
gccgcctcc

SEQ ID NO: 11603 - DNA, 9 bp, Artificial Sequence
  Synthetic construct
agcacaaac

SEQ ID NO: 11604 - DNA, 9 bp, Artificial Sequence
  Synthetic construct
agggcatct

SEQ ID NO: 11605 - DNA, 9 bp, Artificial Sequence
  Synthetic construct
ggtgcttcc

SEQ ID NO: 11606 - DNA, 9 bp, Artificial Sequence
  Synthetic construct
catgcttcc

SEQ ID NO: 11607 - DNA, 9 bp, Artificial Sequence
  Synthetic construct
gatgcattc

SEQ ID NO: 11608 - DNA, 9 bp, Artificial Sequence
  Synthetic construct
aagatttct

SEQ ID NO: 11609 - DNA, 9 bp, Artificial Sequence
  Synthetic construct
tctacttcc

SEQ ID NO: 11610 - DNA, 9 bp, Artificial Sequence
  Synthetic construct
gccgcatcc

SEQ ID NO: 11611 - DNA, 9 bp, Artificial Sequence
  Synthetic construct
ttgggatct

SEQ ID NO: 11612 - DNA, 9 bp, Artificial Sequence
  Synthetic construct
gctgcattc

SEQ ID NO: 11613 - DNA, 9 bp, Artificial Sequence
  Synthetic construct
gataaagac

SEQ ID NO: 11614 - DNA, 9 bp, Artificial Sequence
  Synthetic construct
aggactaat

SEQ ID NO: 11615 - DNA, 9 bp, Artificial Sequence
  Synthetic construct
agggattct

SEQ ID NO: 11616 - DNA, 9 bp, Artificial Sequence
  Synthetic construct
aatgtcagt

SEQ ID NO: 11617 - DNA, 21 bp, Artificial Sequence
  Synthetic construct
cttaacagtgatggcagccac

SEQ ID NO: 11618 - DNA, 9 bp, Artificial Sequence
  Synthetic construct
tctacatcc

SEQ ID NO: 11619 - DNA, 9 bp, Artificial Sequence
  Synthetic construct
gatgcctcc

SEQ ID NO: 11620 - DNA, 9 bp, Artificial Sequence
  Synthetic construct
gaggattac

SEQ ID NO: 11621 - DNA, 9 bp, Artificial Sequence
  Synthetic construct
caagatagc

SEQ ID NO: 11622 - DNA, 9 bp, Artificial Sequence
  Synthetic construct
caggcatct

SEQ ID NO: 11623 - DNA, 9 bp, Artificial Sequence
  Synthetic construct
catgatagc

SEQ ID NO: 11624 - DNA, 9 bp, Artificial Sequence
  Synthetic construct
aataataat

SEQ ID NO: 11625 - DNA, 9 bp, Artificial Sequence
  Synthetic construct
actggaacc

SEQ ID NO: 11626 - DNA, 9 bp, Artificial Sequence
  Synthetic construct
ggaagatac

SEQ ID NO: 11627 - DNA, 9 bp, Artificial Sequence
  Synthetic construct
aataaggac

SEQ ID NO: 11628 - DNA, 9 bp, Artificial Sequence
  Synthetic construct
ggtgcatct

SEQ ID NO: 11629 - DNA, 9 bp, Artificial Sequence
  Synthetic construct
ggtaacatc

SEQ ID NO: 11630 - DNA, 9 bp, Artificial Sequence
  Synthetic construct
gatgatacc

SEQ ID NO: 11631 - DNA, 9 bp, Artificial Sequence
  Synthetic construct
cagtcatct

SEQ ID NO: 11632 - DNA, 9 bp, Artificial Sequence
  Synthetic construct
ggcaataac

SEQ ID NO: 11633 - DNA, 9 bp, Artificial Sequence
  Synthetic construct
gacagtaat

SEQ ID NO: 11634 - DNA, 9 bp, Artificial Sequence
  Synthetic construct
ggtgtgtcc

SEQ ID NO: 11635 - DNA, 9 bp, Artificial Sequence
  Synthetic construct
gaggcgtct

SEQ ID NO: 11636 - DNA, 9 bp, Artificial Sequence
  Synthetic construct
gaagtcagt

SEQ ID NO: 11637 - DNA, 21 bp, Artificial Sequence
  Synthetic construct
cttgatggtagtggaagctac

SEQ ID NO: 11638 - DNA, 9 bp, Artificial Sequence
  Synthetic construct
ggagcgtca

SEQ ID NO: 11639 - DNA, 9 bp, Artificial Sequence
  Synthetic construct
ggggcctct

SEQ ID NO: 11640 - DNA, 9 bp, Artificial Sequence
  Synthetic construct
gatacaact

SEQ ID NO: 11641 - DNA, 9 bp, Artificial Sequence
  Synthetic construct
gctaacagc

SEQ ID NO: 11642 - DNA, 9 bp, Artificial Sequence
  Synthetic construct
atggtttct

SEQ ID NO: 11643 - DNA, 9 bp, Artificial Sequence
  Synthetic construct
gacgtcatt

SEQ ID NO: 11644 - DNA, 9 bp, Artificial Sequence
  Synthetic construct
gatgtcaat

SEQ ID NO: 11645 - DNA, 9 bp, Artificial Sequence
  Synthetic construct
gatgcttct

SEQ ID NO: 11646 - DNA, 9 bp, Artificial Sequence
  Synthetic construct
gaggacaac

SEQ ID NO: 11647 - DNA, 9 bp, Artificial Sequence
  Synthetic construct
aaagacaga

SEQ ID NO: 11648 - DNA, 9 bp, Artificial Sequence
  Synthetic construct
gcgggcagt

SEQ ID NO: 11649 - DNA, 9 bp, Artificial Sequence
  Synthetic construct
caagatact

SEQ ID NO: 11650 - DNA, 9 bp, Artificial Sequence
  Synthetic construct
ggtaataat

SEQ ID NO: 11651 - DNA, 9 bp, Artificial Sequence
  Synthetic construct
gaagtcaat

SEQ ID NO: 11652 - DNA, 9 bp, Artificial Sequence
  Synthetic construct
gatgtcatt

SEQ ID NO: 11653 - DNA, 9 bp, Artificial Sequence
  Synthetic construct
aaggcagtt

SEQ ID NO: 11654 - DNA, 9 bp, Artificial Sequence
  Synthetic construct
agcacagac

SEQ ID NO: 11655 - DNA, 9 bp, Artificial Sequence
  Synthetic construct
gaggtttct

SEQ ID NO: 11656 - DNA, 9 bp, Artificial Sequence
  Synthetic construct
aacacaagc

SEQ ID NO: 11657 - DNA, 9 bp, Artificial Sequence
  Synthetic construct
ttgggttct

SEQ ID NO: 11658 - DNA, 9 bp, Artificial Sequence
  Synthetic construct
gctacatcc

SEQ ID NO: 11659 - DNA, 9 bp, Artificial Sequence
  Synthetic construct
agggtttct

SEQ ID NO: 11660 - DNA, 9 bp, Artificial Sequence
  Synthetic construct
gatgacagc

SEQ ID NO: 11661 - DNA, 9 bp, Artificial Sequence
  Synthetic construct
gaggataca

SEQ ID NO: 11662 - DNA, 9 bp, Artificial Sequence
  Synthetic construct
aaggcctct

SEQ ID NO: 11663 - DNA, 9 bp, Artificial Sequence
  Synthetic construct
ggtgggtca

SEQ ID NO: 11664 - DNA, 9 bp, Artificial Sequence
  Synthetic construct
ggtgatagc

SEQ ID NO: 11665 - DNA, 9 bp, Artificial Sequence
  Synthetic construct
gagactaac

SEQ ID NO: 11666 - DNA, 12 bp, Artificial Sequence
  Synthetic construct
taccactcagac

SEQ ID NO: 11667 - DNA, 9 bp, Artificial Sequence
  Synthetic construct
aggaatgat

SEQ ID NO: 11668 - DNA, 9 bp, Artificial Sequence
  Synthetic construct
gcttcatcc

SEQ ID NO: 11669 - DNA, 9 bp, Artificial Sequence
  Synthetic construct
gacaataat

SEQ ID NO: 11670 - DNA, 9 bp, Artificial Sequence
  Synthetic construct
gctgcctcc

SEQ ID NO: 11671 - DNA, 9 bp, Artificial Sequence
  Synthetic construct
tgggcctct

SEQ ID NO: 11672 - DNA, 9 bp, Artificial Sequence
  Synthetic construct
gaagatacc

SEQ ID NO: 11673 - DNA, 9 bp, Artificial Sequence
  Synthetic construct
gatagttat

SEQ ID NO: 11674 - DNA, 9 bp, Artificial Sequence
  Synthetic construct
gctaaaaac

SEQ ID NO: 11675 - DNA, 9 bp, Artificial Sequence
  Synthetic construct
aagacatct

SEQ ID NO: 11676 - DNA, 9 bp, Artificial Sequence
  Synthetic construct
aaggcgtcc

SEQ ID NO: 11677 - DNA, 9 bp, Artificial Sequence
  Synthetic construct
atggcgtct

SEQ ID NO: 11678 - DNA, 9 bp, Artificial Sequence
  Synthetic construct
gaagcctcc

SEQ ID NO: 11679 - DNA, 9 bp, Artificial Sequence
  Synthetic construct
aaagacaat

SEQ ID NO: 11680 - DNA, 9 bp, Artificial Sequence
  Synthetic construct
ggtaaccgc

SEQ ID NO: 11681 - DNA, 9 bp, Artificial Sequence
  Synthetic construct
gatgaatcc

SEQ ID NO: 11682 - DNA, 9 bp, Artificial Sequence
  Synthetic construct
ggtgaatcc

SEQ ID NO: 11683 - DNA, 9 bp, Artificial Sequence
  Synthetic construct
gacaatagt

SEQ ID NO: 11684 - DNA, 9 bp, Artificial Sequence
  Synthetic construct
caagatagt

SEQ ID NO: 11685 - DNA, 9 bp, Artificial Sequence
  Synthetic construct
gctacattc

SEQ ID NO: 11686 - DNA, 9 bp, Artificial Sequence
  Synthetic construct
caagattcc

SEQ ID NO: 11687 - DNA, 9 bp, Artificial Sequence
  Synthetic construct
gaggcatcc

SEQ ID NO: 11688 - DNA, 9 bp, Artificial Sequence
  Synthetic construct
agcacacac

SEQ ID NO: 11689 - DNA, 9 bp, Artificial Sequence
  Synthetic construct
gatgcaaac

SEQ ID NO: 11690 - DNA, 9 bp, Artificial Sequence
  Synthetic construct
tggtcatct

SEQ ID NO: 11691 - DNA, 9 bp, Artificial Sequence
  Synthetic construct
gaggtcagg

SEQ ID NO: 11692 - DNA, 9 bp, Artificial Sequence
  Synthetic construct
gctgcttcc

SEQ ID NO: 11693 - DNA, 9 bp, Artificial Sequence
  Synthetic construct
tctacatct

SEQ ID NO: 11694 - DNA, 9 bp, Artificial Sequence
  Synthetic construct
gacgtcaat

SEQ ID NO: 11695 - DNA, 9 bp, Artificial Sequence
  Synthetic construct
gatgatagt

SEQ ID NO: 11696 - DNA, 9 bp, Artificial Sequence
  Synthetic construct
gatgcctct

SEQ ID NO: 11697 - DNA, 9 bp, Artificial Sequence
  Synthetic construct
gaaaataat

SEQ ID NO: 11698 - DNA, 9 bp, Artificial Sequence
  Synthetic construct
ttggcttct

SEQ ID NO: 11699 - DNA, 9 bp, Artificial Sequence
  Synthetic construct
caggattct

SEQ ID NO: 11700 - DNA, 9 bp, Artificial Sequence
  Synthetic construct
gatacttcc

SEQ ID NO: 11701 - DNA, 9 bp, Artificial Sequence
  Synthetic construct
gatgctttc

SEQ ID NO: 11702 - DNA, 9 bp, Artificial Sequence
  Synthetic construct
agaatttct

SEQ ID NO: 11703 - DNA, 9 bp, Artificial Sequence
  Synthetic construct
agtcatatt

SEQ ID NO: 11704 - DNA, 9 bp, Artificial Sequence
  Synthetic construct
aaggcgtca

SEQ ID NO: 11705 - DNA, 9 bp, Artificial Sequence
  Synthetic construct
gccgtcagt

SEQ ID NO: 11706 - DNA, 9 bp, Artificial Sequence
  Synthetic construct
ggtgcaacc

SEQ ID NO: 11707 - DNA, 9 bp, Artificial Sequence
  Synthetic construct
gaagtcgtt

SEQ ID NO: 11708 - DNA, 9 bp, Artificial Sequence
  Synthetic construct
catgcgtct

SEQ ID NO: 11709 - DNA, 9 bp, Artificial Sequence
  Synthetic construct
agtgacagt

SEQ ID NO: 11710 - DNA, 9 bp, Artificial Sequence
  Synthetic construct
ggtatctcc

SEQ ID NO: 11711 - DNA, 9 bp, Artificial Sequence
  Synthetic construct
agtgcctcc

SEQ ID NO: 11712 - DNA, 9 bp, Artificial Sequence
  Synthetic construct
gggacttcc

SEQ ID NO: 11713 - DNA, 9 bp, Artificial Sequence
  Synthetic construct
gatgatgac

SEQ ID NO: 11714 - DNA, 9 bp, Artificial Sequence
  Synthetic construct
gacaacaat

SEQ ID NO: 11715 - DNA, 9 bp, Artificial Sequence
  Synthetic construct
gacactact

SEQ ID NO: 11716 - DNA, 9 bp, Artificial Sequence
  Synthetic construct
aatgataat

SEQ ID NO: 11717 - DNA, 9 bp, Artificial Sequence
  Synthetic construct
gatggatcc

SEQ ID NO: 11718 - DNA, 9 bp, Artificial Sequence
  Synthetic construct
gaagtctat

SEQ ID NO: 11719 - DNA, 9 bp, Artificial Sequence
  Synthetic construct
ggggcatcg

SEQ ID NO: 11720 - DNA, 9 bp, Artificial Sequence
  Synthetic construct
gacaatgat

SEQ ID NO: 11721 - DNA, 9 bp, Artificial Sequence
  Synthetic construct
gatgcatca

SEQ ID NO: 11722 - DNA, 9 bp, Artificial Sequence
  Synthetic construct
gaggtttcc

SEQ ID NO: 11723 - DNA, 9 bp, Artificial Sequence
  Synthetic construct
actaataat

SEQ ID NO: 11724 - DNA, 9 bp, Artificial Sequence
  Synthetic construct
gaagttact

SEQ ID NO: 11725 - DNA, 9 bp, Artificial Sequence
  Synthetic construct
tctgcttcc

SEQ ID NO: 11726 - DNA, 9 bp, Artificial Sequence
  Synthetic construct
gctgcatcg

SEQ ID NO: 11727 - DNA, 9 bp, Artificial Sequence
  Synthetic construct
ggggtcact

SEQ ID NO: 11728 - DNA, 9 bp, Artificial Sequence
  Synthetic construct
ggtaacaac

SEQ ID NO: 11729 - DNA, 9 bp, Artificial Sequence
  Synthetic construct
ggtaaaagg

SEQ ID NO: 11730 - DNA, 9 bp, Artificial Sequence
  Synthetic construct
atgatttct

SEQ ID NO: 11731 - DNA, 9 bp, Artificial Sequence
  Synthetic construct
gctgcaagt

SEQ ID NO: 11732 - DNA, 21 bp, Artificial Sequence
  Synthetic construct
tactactcagactcagataag

SEQ ID NO: 11733 - DNA, 9 bp, Artificial Sequence
  Synthetic construct
agtaatgat

SEQ ID NO: 11734 - DNA, 9 bp, Artificial Sequence
  Synthetic construct
gatgatcgg

SEQ ID NO: 11735 - DNA, 9 bp, Artificial Sequence
  Synthetic construct
tctgcctcc

SEQ ID NO: 11736 - DNA, 9 bp, Artificial Sequence
  Synthetic construct
tcggtttct

SEQ ID NO: 11737 - DNA, 9 bp, Artificial Sequence
  Synthetic construct
gctgcattt

SEQ ID NO: 11738 - DNA, 9 bp, Artificial Sequence
  Synthetic construct
ctccgttct

SEQ ID NO: 11739 - DNA, 9 bp, Artificial Sequence
  Synthetic construct
gatgtgtcc

SEQ ID NO: 11740 - DNA, 21 bp, Artificial Sequence
  Synthetic construct
attaaaagtgatggcagttac

SEQ ID NO: 11741 - DNA, 9 bp, Artificial Sequence
  Synthetic construct
gaagcatct

SEQ ID NO: 11742 - DNA, 9 bp, Artificial Sequence
  Synthetic construct
agtacaagc

SEQ ID NO: 11743 - DNA, 9 bp, Artificial Sequence
  Synthetic construct
gatgacaaa

SEQ ID NO: 11744 - DNA, 9 bp, Artificial Sequence
  Synthetic construct
gagggcact

SEQ ID NO: 11745 - DNA, 9 bp, Artificial Sequence
  Synthetic construct
agtactgat

SEQ ID NO: 11746 - DNA, 9 bp, Artificial Sequence
  Synthetic construct
gaaagttat

SEQ ID NO: 11747 - DNA, 9 bp, Artificial Sequence
  Synthetic construct
ggtaacacc

SEQ ID NO: 11748 - DNA, 9 bp, Artificial Sequence
  Synthetic construct
agaacatcc

SEQ ID NO: 11749 - DNA, 9 bp, Artificial Sequence
  Synthetic construct
cttaactcc

SEQ ID NO: 11750 - DNA, 9 bp, Artificial Sequence
  Synthetic construct
gctggttat

SEQ ID NO: 11751 - DNA, 9 bp, Artificial Sequence
  Synthetic construct
gattcatcc

SEQ ID NO: 11752 - DNA, 9 bp, Artificial Sequence
  Synthetic construct
caggttttt

SEQ ID NO: 11753 - DNA, 9 bp, Artificial Sequence
  Synthetic construct
ggagcaacc

SEQ ID NO: 11754 - DNA, 9 bp, Artificial Sequence
  Synthetic construct
agcgataac

SEQ ID NO: 11755 - DNA, 9 bp, Artificial Sequence
  Synthetic construct
gatgatcgc

SEQ ID NO: 11756 - DNA, 9 bp, Artificial Sequence
  Synthetic construct
cttaacagc

SEQ ID NO: 11757 - DNA, 9 bp, Artificial Sequence
  Synthetic construct
agtagtaat

SEQ ID NO: 11758 - DNA, 9 bp, Artificial Sequence
  Synthetic construct
gaggtccgt

SEQ ID NO: 11759 - DNA, 9 bp, Artificial Sequence
  Synthetic construct
gaagtccat

SEQ ID NO: 11760 - DNA, 9 bp, Artificial Sequence
  Synthetic construct
aaagacaaa

SEQ ID NO: 11761 - DNA, 9 bp, Artificial Sequence
  Synthetic construct
gctgtatcc

SEQ ID NO: 11762 - DNA, 9 bp, Artificial Sequence
  Synthetic construct
gagaataat

SEQ ID NO: 11763 - DNA, 9 bp, Artificial Sequence
  Synthetic construct
gcagcatcc

SEQ ID NO: 11764 - DNA, 9 bp, Artificial Sequence
  Synthetic construct
gcgggcaga

SEQ ID NO: 11765 - DNA, 9 bp, Artificial Sequence
  Synthetic construct
gatgataaa

SEQ ID NO: 11766 - DNA, 9 bp, Artificial Sequence
  Synthetic construct
ggtgtctcc

SEQ ID NO: 11767 - DNA, 30 bp, Artificial Sequence
  Synthetic construct
cagcagtatggtaggtcaccccagatcacc

SEQ ID NO: 11768 - DNA, 27 bp, Artificial Sequence
  Synthetic construct
caacaatataagagtttttcttatact

SEQ ID NO: 11769 - DNA, 33 bp, Artificial Sequence
  Synthetic construct
agctcatacagaagcagcaggattctttatgtc

SEQ ID NO: 11770 - DNA, 27 bp, Artificial Sequence
  Synthetic construct
cagcaatatcatatgacccctccgacg

SEQ ID NO: 11771 - DNA, 24 bp, Artificial Sequence
  Synthetic construct
cagcagtttggcagctcacccact

SEQ ID NO: 11772 - DNA, 33 bp, Artificial Sequence
  Synthetic construct
cagcattatggtacctcacctccgatgtacacc

SEQ ID NO: 11773 - DNA, 27 bp, Artificial Sequence
  Synthetic construct
ttgctctcccatagtggtgcttgggtg

SEQ ID NO: 11774 - DNA, 30 bp, Artificial Sequence
  Synthetic construct
tcctcatatgcaggctcttacacttgggtg

SEQ ID NO: 11775 - DNA, 27 bp, Artificial Sequence
  Synthetic construct
cagcagtatgatggctcacctcagacg

SEQ ID NO: 11776 - DNA, 27 bp, Artificial Sequence
  Synthetic construct
caacagtatgatagttttccatacact

SEQ ID NO: 11777 - DNA, 36 bp, Artificial Sequence
  Synthetic construct
agctcatatacaaacaacaacactcctcgttgggtg

SEQ ID NO: 11778 - DNA, 27 bp, Artificial Sequence
  Synthetic construct
cagcaatattttgttcctcccctcact

SEQ ID NO: 11779 - DNA, 33 bp, Artificial Sequence
  Synthetic construct
caatcaacagacagtagtggtgattattggctg

SEQ ID NO: 11780 - DNA, 33 bp, Artificial Sequence
  Synthetic construct
acctcatatacaaacaacagcaattctcaggta

SEQ ID NO: 11781 - DNA, 24 bp, Artificial Sequence
  Synthetic construct
cagcagcgcagcaactggatcacc

SEQ ID NO: 11782 - DNA, 27 bp, Artificial Sequence
  Synthetic construct
cagcaatattatagtactcctcccacg

SEQ ID NO: 11783 - DNA, 27 bp, Artificial Sequence
  Synthetic construct
cagcagtatggtccctcactttgcacc

SEQ ID NO: 11784 - DNA, 33 bp, Artificial Sequence
  Synthetic construct
acctcatatacaaacaacagcaattctcagata

SEQ ID NO: 11785 - DNA, 27 bp, Artificial Sequence
  Synthetic construct
cagcaatattatagtgctcctttcact

SEQ ID NO: 11786 - DNA, 33 bp, Artificial Sequence
  Synthetic construct
cagtcctatgacagcaggctgactacttgggtg

SEQ ID NO: 11787 - DNA, 30 bp, Artificial Sequence
  Synthetic construct
agctcatatgcaggcaacaacaattatctc

SEQ ID NO: 11788 - DNA, 27 bp, Artificial Sequence
  Synthetic construct
cagcaatattatacttctacgtggacg

SEQ ID NO: 11789 - DNA, 33 bp, Artificial Sequence
  Synthetic construct
aattcccgcgacagcagtggtgaccgttatgtc

SEQ ID NO: 11790 - DNA, 30 bp, Artificial Sequence
  Synthetic construct
cactcttatgatagcgccaatccagggata

SEQ ID NO: 11791 - DNA, 27 bp, Artificial Sequence
  Synthetic construct
ctacaacattattctactcctcagact

SEQ ID NO: 11792 - DNA, 27 bp, Artificial Sequence
  Synthetic construct
catcagagtagtgccttaattcaaact

SEQ ID NO: 11793 - DNA, 27 bp, Artificial Sequence
  Synthetic construct
cagcactatggtagctcattgtggacg

SEQ ID NO: 11794 - DNA, 33 bp, Artificial Sequence
  Synthetic construct
cagcagtatggcagctcacctcccccgtacact

SEQ ID NO: 11795 - DNA, 24 bp, Artificial Sequence
  Synthetic construct
cagcagtatggtggctcacccact

SEQ ID NO: 11796 - DNA, 27 bp, Artificial Sequence
  Synthetic construct
cagcagtacggtagttcagtgtggacg

SEQ ID NO: 11797 - DNA, 33 bp, Artificial Sequence
  Synthetic construct
caggtgtgggatagcagtagtgatcatgtggca

SEQ ID NO: 11798 - DNA, 36 bp, Artificial Sequence
  Synthetic construct
tcagcatgggatgaaagtctgaatggtcatgtgata

SEQ ID NO: 11799 - DNA, 24 bp, Artificial Sequence
  Synthetic construct
caacagagcttcagtagtgtcacc

SEQ ID NO: 11800 - DNA, 33 bp, Artificial Sequence
  Synthetic construct
tgctcaaatgcaggttgtaggacttggggtgtc

SEQ ID NO: 11801 - DNA, 27 bp, Artificial Sequence
  Synthetic construct
atgcaaggtatataccttccgctcact

SEQ ID NO: 11802 - DNA, 27 bp, Artificial Sequence
  Synthetic construct
caacagcttaatagtaacccattcact

SEQ ID NO: 11803 - DNA, 24 bp, Artificial Sequence
  Synthetic construct
caacagtattatagttaccccttt

SEQ ID NO: 11804 - DNA, 27 bp, Artificial Sequence
  Synthetic construct
caacagtattatagttacccgtggacg

SEQ ID NO: 11805 - DNA, 30 bp, Artificial Sequence
  Synthetic construct
cagtcatcagacagcagtggtaattttgtc

SEQ ID NO: 11806 - DNA, 36 bp, Artificial Sequence
  Synthetic construct
gcagcatgggatgacagcctgggtggtggggatgtc

SEQ ID NO: 11807 - DNA, 33 bp, Artificial Sequence
  Synthetic construct
ctacagtataatagttcttcttcaacatacact

SEQ ID NO: 11808 - DNA, 30 bp, Artificial Sequence
  Synthetic construct
tgctcgtatgcagggactagcactttcgtg

SEQ ID NO: 11809 - DNA, 27 bp, Artificial Sequence
  Synthetic construct
gaacaggctaacagtttcccgctcact

SEQ ID NO: 11810 - DNA, 39 bp, Artificial Sequence
  Synthetic construct
ggggcagaccatgacagtgggagcaacttcgtttatgtc

SEQ ID NO: 11811 - DNA, 27 bp, Artificial Sequence
  Synthetic construct
caacaacttaatggttaccctccaact

SEQ ID NO: 11812 - DNA, 27 bp, Artificial Sequence
  Synthetic construct
caccagtatagtacctcaccgtggacg

SEQ ID NO: 11813 - DNA, 27 bp, Artificial Sequence
  Synthetic construct
caccaatattataatattcctcgaaca

SEQ ID NO: 11814 - DNA, 24 bp, Artificial Sequence
  Synthetic construct
caccaatattatagtactctcact

SEQ ID NO: 11815 - DNA, 24 bp, Artificial Sequence
  Synthetic construct
atgcaaggtacacacctttacacc

SEQ ID NO: 11816 - DNA, 27 bp, Artificial Sequence
  Synthetic construct
caacatttttatagtagtcctccgact

SEQ ID NO: 11817 - DNA, 33 bp, Artificial Sequence
  Synthetic construct
agctcatatagacgtgacatcgccctttatgtc

SEQ ID NO: 11818 - DNA, 33 bp, Artificial Sequence
  Synthetic construct
acctcatatacaaacgacagcaattctcaggta

SEQ ID NO: 11819 - DNA, 33 bp, Artificial Sequence
  Synthetic construct
tgttcgtatgcaagtagtagcactttcgtgatt

SEQ ID NO: 11820 - DNA, 33 bp, Artificial Sequence
  Synthetic construct
caggtgtgggatagtagtagtgatcattatgtc

SEQ ID NO: 11821 - DNA, 30 bp, Artificial Sequence
  Synthetic construct
caccagcggagcagctggcctccgtacact

SEQ ID NO: 11822 - DNA, 27 bp, Artificial Sequence
  Synthetic construct
atgcagggtacacactggcctcggacg

SEQ ID NO: 11823 - DNA, 27 bp, Artificial Sequence
  Synthetic construct
cagcaatataataactggccgtacact

SEQ ID NO: 11824 - DNA, 27 bp, Artificial Sequence
  Synthetic construct
cagacctgggacactggcgttcgcctg

SEQ ID NO: 11825 - DNA, 36 bp, Artificial Sequence
  Synthetic construct
cagtcctatgacttcagcctgagtggttcggatgtc

SEQ ID NO: 11826 - DNA, 27 bp, Artificial Sequence
  Synthetic construct
caacagtatggtacttcacctgtcact

SEQ ID NO: 11827 - DNA, 30 bp, Artificial Sequence
  Synthetic construct
gagcaacgtattagctggcctggaatcacc

SEQ ID NO: 11828 - DNA, 27 bp, Artificial Sequence
  Synthetic construct
cagcagtacggttattcacggtggaca

SEQ ID NO: 11829 - DNA, 27 bp, Artificial Sequence
  Synthetic construct
atgcaaggtacacactggcctccgggg

SEQ ID NO: 11830 - DNA, 30 bp, Artificial Sequence
  Synthetic construct
tgctcatatgcagctagtagagttaaggtg

SEQ ID NO: 11831 - DNA, 27 bp, Artificial Sequence
  Synthetic construct
caccaatattatactcctccattcact

SEQ ID NO: 11832 - DNA, 30 bp, Artificial Sequence
  Synthetic construct
ctccaccgtaacaactggcctcccttcact

SEQ ID NO: 11833 - DNA, 30 bp, Artificial Sequence
  Synthetic construct
ttgctctcctatagtggtgctcattatgtc

SEQ ID NO: 11834 - DNA, 27 bp, Artificial Sequence
  Synthetic construct
ctacagcatgatagttaccccctcact

SEQ ID NO: 11835 - DNA, 27 bp, Artificial Sequence
  Synthetic construct
ctgcagcatattacctggccttggaca

SEQ ID NO: 11836 - DNA, 30 bp, Artificial Sequence
  Synthetic construct
atgcaaggtacagactggcccccgtacact

SEQ ID NO: 11837 - DNA, 30 bp, Artificial Sequence
  Synthetic construct
atgcaaggtacacactggcctccggtgacg

SEQ ID NO: 11838 - DNA, 27 bp, Artificial Sequence
  Synthetic construct
cagcactatgatcatctcccgtggacc

SEQ ID NO: 11839 - DNA, 27 bp, Artificial Sequence
  Synthetic construct
caacagtgtgatgatctcccgtacact

SEQ ID NO: 11840 - DNA, 27 bp, Artificial Sequence
  Synthetic construct
caacagttttatggtgccccattcact

SEQ ID NO: 11841 - DNA, 27 bp, Artificial Sequence
  Synthetic construct
cagcagcgcagcaactggcctctcact

SEQ ID NO: 11842 - DNA, 27 bp, Artificial Sequence
  Synthetic construct
caacagagttacgcctccccgactacg

SEQ ID NO: 11843 - DNA, 27 bp, Artificial Sequence
  Synthetic construct
caacagagttacagaattcctcacacc

SEQ ID NO: 11844 - DNA, 27 bp, Artificial Sequence
  Synthetic construct
caacagagttacagtaccccgctcact

SEQ ID NO: 11845 - DNA, 24 bp, Artificial Sequence
  Synthetic construct
caacagacttacaatacgatcact

SEQ ID NO: 11846 - DNA, 27 bp, Artificial Sequence
  Synthetic construct
caacaatatgatagtctcccggtcact

SEQ ID NO: 11847 - DNA, 27 bp, Artificial Sequence
  Synthetic construct
caacaatatggtagctccctgtacagt

SEQ ID NO: 11848 - DNA, 27 bp, Artificial Sequence
  Synthetic construct
cagcagtatggtagctcaccgctcact

SEQ ID NO: 11849 - DNA, 33 bp, Artificial Sequence
  Synthetic construct
cagcagtatggtagctcacctccgcggttcact

SEQ ID NO: 11850 - DNA, 27 bp, Artificial Sequence
  Synthetic construct
cagcagtacggctatctgccactgact

SEQ ID NO: 11851 - DNA, 27 bp, Artificial Sequence
  Synthetic construct
caacagtataatgcttacccattcact

SEQ ID NO: 11852 - DNA, 30 bp, Artificial Sequence
  Synthetic construct
cagcagtataatcattggctccctctcact

SEQ ID NO: 11853 - DNA, 30 bp, Artificial Sequence
  Synthetic construct
cagcaatataataagtggcctccgtggacg

SEQ ID NO: 11854 - DNA, 30 bp, Artificial Sequence
  Synthetic construct
cagcagtataataactggcccccattcact

SEQ ID NO: 11855 - DNA, 27 bp, Artificial Sequence
  Synthetic construct
cagcagtataatagctggccatttact

SEQ ID NO: 11856 - DNA, 24 bp, Artificial Sequence
  Synthetic construct
caacagtataatagttattggacg

SEQ ID NO: 11857 - DNA, 30 bp, Artificial Sequence
  Synthetic construct
cagcaatataatgtctggcctacgatcacc

SEQ ID NO: 11858 - DNA, 27 bp, Artificial Sequence
  Synthetic construct
cagcagtatcgtagctcaccattcact

SEQ ID NO: 11859 - DNA, 27 bp, Artificial Sequence
  Synthetic construct
cagcagtatcgttactcaccgaggacg

SEQ ID NO: 11860 - DNA, 24 bp, Artificial Sequence
  Synthetic construct
cagcaatattctagtttcgggact

SEQ ID NO: 11861 - DNA, 27 bp, Artificial Sequence
  Synthetic construct
cagcaatattataatactccgtacact

SEQ ID NO: 11862 - DNA, 27 bp, Artificial Sequence
  Synthetic construct
caacagtattatagtttccctcgaacg

SEQ ID NO: 11863 - DNA, 27 bp, Artificial Sequence
  Synthetic construct
cagcaatattatagtactccgtacact

SEQ ID NO: 11864 - DNA, 27 bp, Artificial Sequence
  Synthetic construct
caacagtattatagttaccctctaacg

SEQ ID NO: 11865 - DNA, 27 bp, Artificial Sequence
  Synthetic construct
caacagtattatactattccgcggacg

SEQ ID NO: 11866 - DNA, 33 bp, Artificial Sequence
  Synthetic construct
caatcagcagacagcggtggtacttctgtgaca

SEQ ID NO: 11867 - DNA, 33 bp, Artificial Sequence
  Synthetic construct
cagtcccgggacagcagtggtaaccagctggtg

SEQ ID NO: 11868 - DNA, 30 bp, Artificial Sequence
  Synthetic construct
caatcagtagacagaagtggttctcatgtc

SEQ ID NO: 11869 - DNA, 33 bp, Artificial Sequence
  Synthetic construct
caggtgtgggatagtagtagtgatcattgggtg

SEQ ID NO: 11870 - DNA, 33 bp, Artificial Sequence
  Synthetic construct
acctcatatacaaacgacagcaattctcaggca

SEQ ID NO: 11871 - DNA, 33 bp, Artificial Sequence
  Synthetic construct
acctcatatacaaacgacagcaattctcagcta

SEQ ID NO: 11872 - DNA, 33 bp, Artificial Sequence
  Synthetic construct
acctcatatacaaacgacaccaattctcaggta

SEQ ID NO: 11873 - DNA, 33 bp, Artificial Sequence
  Synthetic construct
acctcatatacaaacaacaacaattctcaggta

SEQ ID NO: 11874 - DNA, 33 bp, Artificial Sequence
  Synthetic construct
acctcatatacaaacaacagcaattctcatgta

SEQ ID NO: 11875 - DNA, 33 bp, Artificial Sequence
  Synthetic construct
acctcatatacaaacaacagcaattcccaggta

SEQ ID NO: 11876 - DNA, 27 bp, Artificial Sequence
  Synthetic construct
caacactatgatcatctccctctcact

SEQ ID NO: 11877 - DNA, 27 bp, Artificial Sequence
  Synthetic construct
cagcagtatggtagctcaccgtggacg

SEQ ID NO: 11878 - DNA, 27 bp, Artificial Sequence
  Synthetic construct
cagcagtattatagtacttcgtggacg

SEQ ID NO: 11879 - DNA, 24 bp, Artificial Sequence
  Synthetic construct
cagcaatatggtaattcagggacg

SEQ ID NO: 11880 - DNA, 24 bp, Artificial Sequence
  Synthetic construct
cagcagtatggtggctcatccacc

SEQ ID NO: 11881 - DNA, 30 bp, Artificial Sequence
  Synthetic construct
cagcagcgtagcaactggccttcgctcact

SEQ ID NO: 11882 - DNA, 36 bp, Artificial Sequence
  Synthetic construct
aactcccgggacagcagtggtaaccatctgggggtc

SEQ ID NO: 11883 - DNA, 33 bp, Artificial Sequence
  Synthetic construct
caggtgtgggatagtagtagtgatcatgtggta

SEQ ID NO: 11884 - DNA, 27 bp, Artificial Sequence
  Synthetic construct
cagcagtataagagctggcccctcgcg

SEQ ID NO: 11885 - DNA, 33 bp, Artificial Sequence
  Synthetic construct
gcagcgtgggatgacaccctgagtgcttgggtg

SEQ ID NO: 11886 - DNA, 27 bp, Artificial Sequence
  Synthetic construct
cagcagtatggtagctcacctcaaacg

SEQ ID NO: 11887 - DNA, 30 bp, Artificial Sequence
  Synthetic construct
cagcagcgtagcaactggcctccgtggacg

SEQ ID NO: 11888 - DNA, 27 bp, Artificial Sequence
  Synthetic construct
atgcaacgtatagagtttccgtggacg

SEQ ID NO: 11889 - DNA, 36 bp, Artificial Sequence
  Synthetic construct
gcagcatgggatgacagcctgagtggtcggggggta

SEQ ID NO: 11890 - DNA, 27 bp, Artificial Sequence
  Synthetic construct
caacagagttacagtaccccgtacact

SEQ ID NO: 11891 - DNA, 30 bp, Artificial Sequence
  Synthetic construct
tgctcatatgcaggcagctacacttgggtg

SEQ ID NO: 11892 - DNA, 27 bp, Artificial Sequence
  Synthetic construct
gtacaggattacgattaccctcataca

SEQ ID NO: 11893 - DNA, 33 bp, Artificial Sequence
  Synthetic construct
acctcatatacaaacgacagcaattctcaggtc

SEQ ID NO: 11894 - DNA, 33 bp, Artificial Sequence
  Synthetic construct
caatcagtaggcactaatcatctttctgtggtc

SEQ ID NO: 11895 - DNA, 33 bp, Artificial Sequence
  Synthetic construct
acctcatatgcaggcagcaacaatttcagggtc

SEQ ID NO: 11896 - DNA, 33 bp, Artificial Sequence
  Synthetic construct
gccgcttgggatgaccacctgcgaattgtgggt

SEQ ID NO: 11897 - DNA, 33 bp, Artificial Sequence
  Synthetic construct
caatcttatgataccaccacggatcatgcagtc

SEQ ID NO: 11898 - DNA, 27 bp, Artificial Sequence
  Synthetic construct
caacagtatcatagtaccccgtggacg

SEQ ID NO: 11899 - DNA, 27 bp, Artificial Sequence
  Synthetic construct
ctacaacataatagttaccctcgaacg

SEQ ID NO: 11900 - DNA, 27 bp, Artificial Sequence
  Synthetic construct
caacagtatagtactgattcggcgacg

SEQ ID NO: 11901 - DNA, 36 bp, Artificial Sequence
  Synthetic construct
cagtcctatgacagtagcctgagtgattcgaaagta

SEQ ID NO: 11902 - DNA, 27 bp, Artificial Sequence
  Synthetic construct
cagcaatcttatactagtcctgtcact

SEQ ID NO: 11903 - DNA, 27 bp, Artificial Sequence
  Synthetic construct
cagcagtatgcttcctcaccggtcact

SEQ ID NO: 11904 - DNA, 27 bp, Artificial Sequence
  Synthetic construct
caacactgtgatagttatccgtggacg

SEQ ID NO: 11905 - DNA, 27 bp, Artificial Sequence
  Synthetic construct
tactctgcggctgacaacaatcgagtc

SEQ ID NO: 11906 - DNA, 33 bp, Artificial Sequence
  Synthetic construct
caggcgtgggatgttgatagtgatcaaatggtt

SEQ ID NO: 11907 - DNA, 24 bp, Artificial Sequence
  Synthetic construct
cagcagtatgctacctcaccgact

SEQ ID NO: 11908 - DNA, 30 bp, Artificial Sequence
  Synthetic construct
cagcagtattataactggcctccgcacact

SEQ ID NO: 11909 - DNA, 27 bp, Artificial Sequence
  Synthetic construct
ctgcggtgtaacggtttccctctcact

SEQ ID NO: 11910 - DNA, 30 bp, Artificial Sequence
  Synthetic construct
cagcactatcctatgtcacctccgatcacc

SEQ ID NO: 11911 - DNA, 24 bp, Artificial Sequence
  Synthetic construct
caacagtatcagagttattcgact

SEQ ID NO: 11912 - DNA, 33 bp, Artificial Sequence
  Synthetic construct
gcagcatgggatgacaccctgcatggtgtggtt

SEQ ID NO: 11913 - DNA, 27 bp, Artificial Sequence
  Synthetic construct
tactctgcggctgacaagagtctggta

SEQ ID NO: 11914 - DNA, 36 bp, Artificial Sequence
  Synthetic construct
caatccgcagacagtagtggttcttatcctgtggtt

SEQ ID NO: 11915 - DNA, 30 bp, Artificial Sequence
  Synthetic construct
agctcattggaaggcaggaacaattgggtg

SEQ ID NO: 11916 - DNA, 27 bp, Artificial Sequence
  Synthetic construct
caacagtataagagttacaagtggacg

SEQ ID NO: 11917 - DNA, 36 bp, Artificial Sequence
  Synthetic construct
cagtcctttgacaacagtgtgggtgtccaagtgatt

SEQ ID NO: 11918 - DNA, 27 bp, Artificial Sequence
  Synthetic construct
atgcagcatctaaaaattcctcggact

SEQ ID NO: 11919 - DNA, 33 bp, Artificial Sequence
  Synthetic construct
cagcagtatagtggctcacttcccccatacact

SEQ ID NO: 11920 - DNA, 27 bp, Artificial Sequence
  Synthetic construct
cagtcttatgatggcagcaatcagtta

SEQ ID NO: 11921 - DNA, 33 bp, Artificial Sequence
  Synthetic construct
caacagtataatacttactctcccacgtgggca

SEQ ID NO: 11922 - DNA, 27 bp, Artificial Sequence
  Synthetic construct
caacactataatagttacccgtacact

SEQ ID NO: 11923 - DNA, 30 bp, Artificial Sequence
  Synthetic construct
caggcgtgggacagcaacacttttgtgatg

SEQ ID NO: 11924 - DNA, 30 bp, Artificial Sequence
  Synthetic construct
caacaatataatgactggcctccggtcact

SEQ ID NO: 11925 - DNA, 24 bp, Artificial Sequence
  Synthetic construct
cagcaatatggtagctcacccact

SEQ ID NO: 11926 - DNA, 27 bp, Artificial Sequence
  Synthetic construct
cagcagtattttcgtagtcctcacacg

SEQ ID NO: 11927 - DNA, 27 bp, Artificial Sequence
  Synthetic construct
atgcaagggacacactggcctctgact

SEQ ID NO: 11928 - DNA, 27 bp, Artificial Sequence
  Synthetic construct
caacagtataatagtctcccgtggacg

SEQ ID NO: 11929 - DNA, 30 bp, Artificial Sequence
  Synthetic construct
cagcaatttggtggctcccctctgtacact

SEQ ID NO: 11930 - DNA, 30 bp, Artificial Sequence
  Synthetic construct
cagcagtattatgactggcctccgtggacg

SEQ ID NO: 11931 - DNA, 36 bp, Artificial Sequence
  Synthetic construct
gttgcatgggatgtcaatctgagtggtcctgtgctc

SEQ ID NO: 11932 - DNA, 30 bp, Artificial Sequence
  Synthetic construct
caacagagttacagtaccctcgcggtcact

SEQ ID NO: 11933 - DNA, 30 bp, Artificial Sequence
  Synthetic construct
cttctctatatgggtactggctcttgggtg

SEQ ID NO: 11934 - DNA, 27 bp, Artificial Sequence
  Synthetic construct
cagcagtatgttagttcacccctgacg

SEQ ID NO: 11935 - DNA, 27 bp, Artificial Sequence
  Synthetic construct
caccagtatggtagttcagcgaggact

SEQ ID NO: 11936 - DNA, 27 bp, Artificial Sequence
  Synthetic construct
caacactatgatagatattcagcgacg

SEQ ID NO: 11937 - DNA, 27 bp, Artificial Sequence
  Synthetic construct
caacagtatggcagttcgcctcagacg

SEQ ID NO: 11938 - DNA, 24 bp, Artificial Sequence
  Synthetic construct
catcagagtagtagttggtacact

SEQ ID NO: 11939 - DNA, 33 bp, Artificial Sequence
  Synthetic construct
cagcagcggagcaatgggcgtccgagggtcact

SEQ ID NO: 11940 - DNA, 27 bp, Artificial Sequence
  Synthetic construct
ctacaagattacaattacccctggaag

SEQ ID NO: 11941 - DNA, 27 bp, Artificial Sequence
  Synthetic construct
caacagagttacagtaccccgtggacg

SEQ ID NO: 11942 - DNA, 24 bp, Artificial Sequence
  Synthetic construct
cagcagtatggtagctcaccaacg

SEQ ID NO: 11943 - DNA, 27 bp, Artificial Sequence
  Synthetic construct
atgcaagctacacaatttcctcagacg

SEQ ID NO: 11944 - DNA, 30 bp, Artificial Sequence
  Synthetic construct
cagcagtataataactggcctacgtacact

SEQ ID NO: 11945 - DNA, 33 bp, Artificial Sequence
  Synthetic construct
caatcagcagacagcagtggtacttatgtggta

SEQ ID NO: 11946 - DNA, 30 bp, Artificial Sequence
  Synthetic construct
tgctcatatgcaggcagctacacttatgtc

SEQ ID NO: 11947 - DNA, 27 bp, Artificial Sequence
  Synthetic construct
ctacaggattacaattacccgtgggcg

SEQ ID NO: 11948 - DNA, 27 bp, Artificial Sequence
  Synthetic construct
cagtcttatgaaaacagttattgggtg

SEQ ID NO: 11949 - DNA, 27 bp, Artificial Sequence
  Synthetic construct
cagcaatattataactggcctcggacg

SEQ ID NO: 11950 - DNA, 33 bp, Artificial Sequence
  Synthetic construct
caggtgtgggatagtagtggtgatcatccggtg

SEQ ID NO: 11951 - DNA, 30 bp, Artificial Sequence
  Synthetic construct
tgctcatatgcaggcagctacactcatgtc

SEQ ID NO: 11952 - DNA, 30 bp, Artificial Sequence
  Synthetic construct
caggaatttcatgatactctcgggctcact

SEQ ID NO: 11953 - DNA, 27 bp, Artificial Sequence
  Synthetic construct
cagcagacttacagtgccccatggacg

SEQ ID NO: 11954 - DNA, 30 bp, Artificial Sequence
  Synthetic construct
caacattatgttaactggcctccgtggacg

SEQ ID NO: 11955 - DNA, 27 bp, Artificial Sequence
  Synthetic construct
ctacaacataatagttaccctctcact

SEQ ID NO: 11956 - DNA, 27 bp, Artificial Sequence
  Synthetic construct
atgcaggctctacagactcctcccacc

SEQ ID NO: 11957 - DNA, 27 bp, Artificial Sequence
  Synthetic construct
caacagagttacagcacccccttcact

SEQ ID NO: 11958 - DNA, 33 bp, Artificial Sequence
  Synthetic construct
tattcccgtgccggtactggtgaccatgtggtg

SEQ ID NO: 11959 - DNA, 30 bp, Artificial Sequence
  Synthetic construct
cagcagcgtagcgactggccgcctctcact

SEQ ID NO: 11960 - DNA, 27 bp, Artificial Sequence
  Synthetic construct
cagcagtataatgactggccgtggacg

SEQ ID NO: 11961 - DNA, 27 bp, Artificial Sequence
  Synthetic construct
caaaagtataacagtgccccgctcact

SEQ ID NO: 11962 - DNA, 27 bp, Artificial Sequence
  Synthetic construct
caaaactataacagtgccccattcact

SEQ ID NO: 11963 - DNA, 33 bp, Artificial Sequence
  Synthetic construct
aactcccgggacaccagtggtaaccgttgggtg

SEQ ID NO: 11964 - DNA, 27 bp, Artificial Sequence
  Synthetic construct
cagcagtataatgactggctgatcacg

SEQ ID NO: 11965 - DNA, 33 bp, Artificial Sequence
  Synthetic construct
gcatcatgggatgacagcctgaatggttggggg

SEQ ID NO: 11966 - DNA, 30 bp, Artificial Sequence
  Synthetic construct
caggtgtgggatagtagtactgatcatcta

SEQ ID NO: 11967 - DNA, 33 bp, Artificial Sequence
  Synthetic construct
gcagtttgggatgacaacctgagggcttgggtg

SEQ ID NO: 11968 - DNA, 27 bp, Artificial Sequence
  Synthetic construct
caaaagtataacagtgccccattcact

SEQ ID NO: 11969 - DNA, 27 bp, Artificial Sequence
  Synthetic construct
caacagtataatacttattcgtacact

SEQ ID NO: 11970 - DNA, 27 bp, Artificial Sequence
  Synthetic construct
caacagtataaaagttattcgtggacg

SEQ ID NO: 11971 - DNA, 33 bp, Artificial Sequence
  Synthetic construct
cagatttgggatattgacagtgatcattgggtg

SEQ ID NO: 11972 - DNA, 30 bp, Artificial Sequence
  Synthetic construct
tgctcatatgcaggcagttacacttttctc

SEQ ID NO: 11973 - DNA, 30 bp, Artificial Sequence
  Synthetic construct
caggtgtggaatagtattagtgattatgtc

SEQ ID NO: 11974 - DNA, 33 bp, Artificial Sequence
  Synthetic construct
cagtcctatgacagcagcctgagtgccgtggta

SEQ ID NO: 11975 - DNA, 27 bp, Artificial Sequence
  Synthetic construct
cagacctggggcactggcattcaggtg

SEQ ID NO: 11976 - DNA, 27 bp, Artificial Sequence
  Synthetic construct
caacagtattatagttaccctccgacg

SEQ ID NO: 11977 - DNA, 33 bp, Artificial Sequence
  Synthetic construct
caatcagcagacagcagtggtacttatcgggta

SEQ ID NO: 11978 - DNA, 27 bp, Artificial Sequence
  Synthetic construct
cagcaatattatagtactcttcggacg

SEQ ID NO: 11979 - DNA, 27 bp, Artificial Sequence
  Synthetic construct
ttgctctcctatagtggtgcttgggtg

SEQ ID NO: 11980 - DNA, 27 bp, Artificial Sequence
  Synthetic construct
caacagacttacagtgccccgtacact

SEQ ID NO: 11981 - DNA, 33 bp, Artificial Sequence
  Synthetic construct
caatcagcagacagcagtggtctttattatgtc

SEQ ID NO: 11982 - DNA, 30 bp, Artificial Sequence
  Synthetic construct
caacagagttacagtacccccctgtacact

SEQ ID NO: 11983 - DNA, 27 bp, Artificial Sequence
  Synthetic construct
ctacaagattacaattaccctcgaacg

SEQ ID NO: 11984 - DNA, 27 bp, Artificial Sequence
  Synthetic construct
cagcagcgtagcaactggccggagact

SEQ ID NO: 11985 - DNA, 30 bp, Artificial Sequence
  Synthetic construct
cagcagcgtagcaactggcctccgatcacc

SEQ ID NO: 11986 - DNA, 33 bp, Artificial Sequence
  Synthetic construct
aactcccgggacagcagtggcaagcatctgcta

SEQ ID NO: 11987 - DNA, 27 bp, Artificial Sequence
  Synthetic construct
cagtcttatgatagtacttatagggtg

SEQ ID NO: 11988 - DNA, 36 bp, Artificial Sequence
  Synthetic construct
aattcccgggacatgagtggtaaccatctgggggtc

SEQ ID NO: 11989 - DNA, 27 bp, Artificial Sequence
  Synthetic construct
caacagtataatagttattctcagacg

SEQ ID NO: 11990 - DNA, 36 bp, Artificial Sequence
  Synthetic construct
caggtgtgggatagtagtagtgatcatccgggggta

SEQ ID NO: 11991 - DNA, 27 bp, Artificial Sequence
  Synthetic construct
caacagtataatagttattctcggacg

SEQ ID NO: 11992 - DNA, 33 bp, Artificial Sequence
  Synthetic construct
caggcgtgggacagcagcactgccctttatgtc

SEQ ID NO: 11993 - DNA, 27 bp, Artificial Sequence
  Synthetic construct
caacagtattatagttacccgctcact

SEQ ID NO: 11994 - DNA, 27 bp, Artificial Sequence
  Synthetic construct
cagcagtataataactggcctccgacg

SEQ ID NO: 11995 - DNA, 30 bp, Artificial Sequence
  Synthetic construct
cagcagtataataactggcctccgtacact

SEQ ID NO: 11996 - DNA, 33 bp, Artificial Sequence
  Synthetic construct
aactcccgggacagcagtggtaaccattatgtc

SEQ ID NO: 11997 - DNA, 27 bp, Artificial Sequence
  Synthetic construct
caacagtataatagttatctattcact

SEQ ID NO: 11998 - DNA, 27 bp, Artificial Sequence
  Synthetic construct
caacaggccaacagtttcccgctctct

SEQ ID NO: 11999 - DNA, 27 bp, Artificial Sequence
  Synthetic construct
cagcaccgcagcacctggcctccgacg

SEQ ID NO: 12000 - DNA, 15 bp, Artificial Sequence
  Synthetic construct
caacaccttaggacg

SEQ ID NO: 12001 - DNA, 30 bp, Artificial Sequence
  Synthetic construct
tgctcatatgcaggtagtagtacttatgtc

SEQ ID NO: 12002 - DNA, 27 bp, Artificial Sequence
  Synthetic construct
cagcaatatcatagctggccgggcact

SEQ ID NO: 12003 - DNA, 27 bp, Artificial Sequence
  Synthetic construct
catcaatataatagttatccgacaaca

SEQ ID NO: 12004 - DNA, 27 bp, Artificial Sequence
  Synthetic construct
caacactatgataattatccgtggacg

SEQ ID NO: 12005 - DNA, 33 bp, Artificial Sequence
  Synthetic construct
caggtgtgggataacaatagtgaacatgaagtc

SEQ ID NO: 12006 - DNA, 30 bp, Artificial Sequence
  Synthetic construct
caacaatatgatagtcgttttccgtacact

SEQ ID NO: 12007 - DNA, 33 bp, Artificial Sequence
  Synthetic construct
gcagcatgggatgacagcctgaatggtccggtc

SEQ ID NO: 12008 - DNA, 33 bp, Artificial Sequence
  Synthetic construct
cagttgtataataactggcctcggagaatcact

SEQ ID NO: 12009 - DNA, 24 bp, Artificial Sequence
  Synthetic construct
caacattataatacttatagggcg

SEQ ID NO: 12010 - DNA, 27 bp, Artificial Sequence
  Synthetic construct
cagcaatactatactactccgtacact

SEQ ID NO: 12011 - DNA, 33 bp, Artificial Sequence
  Synthetic construct
tgcgcaatggacgtcaggagtcaccaggtgaaa

SEQ ID NO: 12012 - DNA, 27 bp, Artificial Sequence
  Synthetic construct
caacagtataatagttatctgtggacg

SEQ ID NO: 12013 - DNA, 30 bp, Artificial Sequence
  Synthetic construct
agctcatatacaagcagcagcactcgggtc

SEQ ID NO: 12014 - DNA, 36 bp, Artificial Sequence
  Synthetic construct
aactcctgggacaccagtggtaactatcccgtgata

SEQ ID NO: 12015 - DNA, 24 bp, Artificial Sequence
  Synthetic construct
caccaatatgacaccatgtacact

SEQ ID NO: 12016 - DNA, 36 bp, Artificial Sequence
  Synthetic construct
cagtcctatgacagcagcctgagtgtcttttatgtc

SEQ ID NO: 12017 - DNA, 33 bp, Artificial Sequence
  Synthetic construct
caggtgtgggatagtactggcgatcatgtggtc

SEQ ID NO: 12018 - DNA, 27 bp, Artificial Sequence
  Synthetic construct
cagcagcgtggcgactggcctccgacc

SEQ ID NO: 12019 - DNA, 36 bp, Artificial Sequence
  Synthetic construct
agctcatatacaagcagcagcactctcgatgtggta

SEQ ID NO: 12020 - DNA, 27 bp, Artificial Sequence
  Synthetic construct
agctcatatgcaggcagctctgtggta

SEQ ID NO: 12021 - DNA, 24 bp, Artificial Sequence
  Synthetic construct
cagcagtatggtagctcactcact

SEQ ID NO: 12022 - DNA, 24 bp, Artificial Sequence
  Synthetic construct
cagcagtataataactggcctcgt

SEQ ID NO: 12023 - DNA, 27 bp, Artificial Sequence
  Synthetic construct
caacagtataataactggcctcgaacg

SEQ ID NO: 12024 - DNA, 33 bp, Artificial Sequence
  Synthetic construct
ggaacatatgatcgcagcctgagtgcttgggtg

SEQ ID NO: 12025 - DNA, 33 bp, Artificial Sequence
  Synthetic construct
ggaacatgggatgccgaattgagagcgagggtg

SEQ ID NO: 12026 - DNA, 39 bp, Artificial Sequence
  Synthetic construct
caggtgtgggatagcagtagtgatcctccgtgtgtggtg

SEQ ID NO: 12027 - DNA, 27 bp, Artificial Sequence
  Synthetic construct
caacagagttacaatatcccgtacacc

SEQ ID NO: 12028 - DNA, 30 bp, Artificial Sequence
  Synthetic construct
caacactatgcttactcaccaccgtggacg

SEQ ID NO: 12029 - DNA, 21 bp, Artificial Sequence
  Synthetic construct
caacagtataatagttacact

SEQ ID NO: 12030 - DNA, 30 bp, Artificial Sequence
  Synthetic construct
agctcatatacaaccaggattccttgtgtc

SEQ ID NO: 12031 - DNA, 27 bp, Artificial Sequence
  Synthetic construct
gagacctgggacagttacactcaggtg

SEQ ID NO: 12032 - DNA, 27 bp, Artificial Sequence
  Synthetic construct
cagcaatattttaattctcccatcacc

SEQ ID NO: 12033 - DNA, 27 bp, Artificial Sequence
  Synthetic construct
caacaatataatagttacatgtacact

SEQ ID NO: 12034 - DNA, 27 bp, Artificial Sequence
  Synthetic construct
caaaagtataaccgtgccccccacact

SEQ ID NO: 12035 - DNA, 27 bp, Artificial Sequence
  Synthetic construct
caacagtataatagttattcgtggacg

SEQ ID NO: 12036 - DNA, 27 bp, Artificial Sequence
  Synthetic construct
caacagtatgatagttatcctcgaacg

SEQ ID NO: 12037 - DNA, 27 bp, Artificial Sequence
  Synthetic construct
caacaatataatatctatccggaaacg

SEQ ID NO: 12038 - DNA, 30 bp, Artificial Sequence
  Synthetic construct
cagcaccgtagcaactggcctccgtacact

SEQ ID NO: 12039 - DNA, 30 bp, Artificial Sequence
  Synthetic construct
ttactcgcctttggtggtgtccggtgggtg

SEQ ID NO: 12040 - DNA, 33 bp, Artificial Sequence
  Synthetic construct
cagtcctatgacagccgcctgagtggttatgtc

SEQ ID NO: 12041 - DNA, 24 bp, Artificial Sequence
  Synthetic construct
caacagtatgataatctgatcacc

SEQ ID NO: 12042 - DNA, 24 bp, Artificial Sequence
  Synthetic construct
caacagtataatagttattcaact

SEQ ID NO: 12043 - DNA, 27 bp, Artificial Sequence
  Synthetic construct
caacaatataatagtgtcttatacact

SEQ ID NO: 12044 - DNA, 27 bp, Artificial Sequence
  Synthetic construct
atgcaaggtgcgcagtggcccccgacg

SEQ ID NO: 12045 - DNA, 27 bp, Artificial Sequence
  Synthetic construct
caccagtatggcagttcgcgtcagacg

SEQ ID NO: 12046 - DNA, 33 bp, Artificial Sequence
  Synthetic construct
tcctcatattcgcgcagcagcgattcttatgtc

SEQ ID NO: 12047 - DNA, 30 bp, Artificial Sequence
  Synthetic construct
cagcaatattataccagtcctccgtatact

SEQ ID NO: 12048 - DNA, 24 bp, Artificial Sequence
  Synthetic construct
caacaatatcaaagttattcttct

SEQ ID NO: 12049 - DNA, 27 bp, Artificial Sequence
  Synthetic construct
catcaatattatgactggccgtggacg

SEQ ID NO: 12050 - DNA, 30 bp, Artificial Sequence
  Synthetic construct
cagcactataataagtggccccctttcact

SEQ ID NO: 12051 - DNA, 30 bp, Artificial Sequence
  Synthetic construct
agctcatatacaaccagcaacactctggta

SEQ ID NO: 12052 - DNA, 30 bp, Artificial Sequence
  Synthetic construct
cagcagtataataactggcctccgttcact

SEQ ID NO: 12053 - DNA, 30 bp, Artificial Sequence
  Synthetic construct
caacagagttacagtacccctcggatcact

SEQ ID NO: 12054 - DNA, 30 bp, Artificial Sequence
  Synthetic construct
caacagtattatagtacccctccgctcact

SEQ ID NO: 12055 - DNA, 27 bp, Artificial Sequence
  Synthetic construct
caacagagttacttgaacaggtggacg

SEQ ID NO: 12056 - DNA, 33 bp, Artificial Sequence
  Synthetic construct
tattcaacagacagcagtggtactcatagggta

SEQ ID NO: 12057 - DNA, 30 bp, Artificial Sequence
  Synthetic construct
caacaatatgaaattctgcctcggttcact

SEQ ID NO: 12058 - DNA, 27 bp, Artificial Sequence
  Synthetic construct
caacagtataatagttaccctttcact

SEQ ID NO: 12059 - DNA, 30 bp, Artificial Sequence
  Synthetic construct
cagcagtataagaactggcctccgaacact

SEQ ID NO: 12060 - DNA, 27 bp, Artificial Sequence
  Synthetic construct
cagcagtatggtaactcacagatcacg

SEQ ID NO: 12061 - DNA, 27 bp, Artificial Sequence
  Synthetic construct
catcagagttatactttagcgaacact

SEQ ID NO: 12062 - DNA, 27 bp, Artificial Sequence
  Synthetic construct
caacaggctaacagtttcccaatcacc

SEQ ID NO: 12063 - DNA, 33 bp, Artificial Sequence
  Synthetic construct
caacagagttacagtgcccctccggtgtacagt

SEQ ID NO: 12064 - DNA, 27 bp, Artificial Sequence
  Synthetic construct
cagcagtatggtacctcacctctgacg

SEQ ID NO: 12065 - DNA, 27 bp, Artificial Sequence
  Synthetic construct
cagcaatattttggtactcctctcact

SEQ ID NO: 12066 - DNA, 24 bp, Artificial Sequence
  Synthetic construct
caacagtataatagttatccgacg

SEQ ID NO: 12067 - DNA, 30 bp, Artificial Sequence
  Synthetic construct
tgctcatatgcaggtagtagcactttcgtc

SEQ ID NO: 12068 - DNA, 27 bp, Artificial Sequence
  Synthetic construct
ctacagcataatagttatccgtggacg

SEQ ID NO: 12069 - DNA, 27 bp, Artificial Sequence
  Synthetic construct
caggcgtgggacacaagcgctgcgatt

SEQ ID NO: 12070 - DNA, 30 bp, Artificial Sequence
  Synthetic construct
aactcccgttacagcagtgcttaccaggtg

SEQ ID NO: 12071 - DNA, 27 bp, Artificial Sequence
  Synthetic construct
cagcagtgtgataatctccctttcact

SEQ ID NO: 12072 - DNA, 27 bp, Artificial Sequence
  Synthetic construct
caacaatataatagtttcccgtacact

SEQ ID NO: 12073 - DNA, 27 bp, Artificial Sequence
  Synthetic construct
atgcaagatgcacaggatctgtggacg

SEQ ID NO: 12074 - DNA, 30 bp, Artificial Sequence
  Synthetic construct
cagcaatattatagtactcttccgtcgacg

SEQ ID NO: 12075 - DNA, 27 bp, Artificial Sequence
  Synthetic construct
cagtcttacgatagcatctcttgggtg

SEQ ID NO: 12076 - DNA, 27 bp, Artificial Sequence
  Synthetic construct
atgcaaggtacacactggccccggacg

SEQ ID NO: 12077 - DNA, 33 bp, Artificial Sequence
  Synthetic construct
ggcacatgggatagcagcctgggaggtgtggtc

SEQ ID NO: 12078 - DNA, 30 bp, Artificial Sequence
  Synthetic construct
cagcagcgtagcaactggcctccgctcact

SEQ ID NO: 12079 - DNA, 27 bp, Artificial Sequence
  Synthetic construct
cagacctggggcactggcattcatgtc

SEQ ID NO: 12080 - DNA, 30 bp, Artificial Sequence
  Synthetic construct
agctcatatacaagcagcagcactcaggtc

SEQ ID NO: 12081 - DNA, 27 bp, Artificial Sequence
  Synthetic construct
caacagtattatagttacccattcact

SEQ ID NO: 12082 - DNA, 33 bp, Artificial Sequence
  Synthetic construct
acctcatatacaaacaacaccaattctcaggta

SEQ ID NO: 12083 - DNA, 27 bp, Artificial Sequence
  Synthetic construct
caacagagttacagtaccccccggacg

SEQ ID NO: 12084 - DNA, 30 bp, Artificial Sequence
  Synthetic construct
caacagtataatagttattccctggggact

SEQ ID NO: 12085 - DNA, 30 bp, Artificial Sequence
  Synthetic construct
tgctcatatgcaggtaataatatcccgcta

SEQ ID NO: 12086 - DNA, 30 bp, Artificial Sequence
  Synthetic construct
atgcaaggtacacactggcctccgctcact

SEQ ID NO: 12087 - DNA, 30 bp, Artificial Sequence
  Synthetic construct
cagtcctatgacagcagcctgagtggagtc

SEQ ID NO: 12088 - DNA, 27 bp, Artificial Sequence
  Synthetic construct
cagcaatattatagtacttcgtacact

SEQ ID NO: 12089 - DNA, 30 bp, Artificial Sequence
  Synthetic construct
agctcatatacaatccgcagcacccatgtc

SEQ ID NO: 12090 - DNA, 27 bp, Artificial Sequence
  Synthetic construct
cagcaatatggtagccctccgtggacg

SEQ ID NO: 12091 - DNA, 27 bp, Artificial Sequence
  Synthetic construct
caacagtatgatagttatccggaaacg

SEQ ID NO: 12092 - DNA, 27 bp, Artificial Sequence
  Synthetic construct
cagacctggggcactggcccttgggtg

SEQ ID NO: 12093 - DNA, 27 bp, Artificial Sequence
  Synthetic construct
cagcagcgtagcaactggcctctcact

SEQ ID NO: 12094 - DNA, 27 bp, Artificial Sequence
  Synthetic construct
catcagagtagtagtttacctttcact

SEQ ID NO: 12095 - DNA, 27 bp, Artificial Sequence
  Synthetic construct
cagcagtatcataactcactggacact

SEQ ID NO: 12096 - DNA, 27 bp, Artificial Sequence
  Synthetic construct
cagcaatattatactactccgtggacg

SEQ ID NO: 12097 - DNA, 33 bp, Artificial Sequence
  Synthetic construct
cagcagtatggtagctcacctccggcattcact

SEQ ID NO: 12098 - DNA, 30 bp, Artificial Sequence
  Synthetic construct
gtgctctttgtgggtggtggcatttggcta

SEQ ID NO: 12099 - DNA, 27 bp, Artificial Sequence
  Synthetic construct
atgcagggtgcacactggccgtacact

SEQ ID NO: 12100 - DNA, 30 bp, Artificial Sequence
  Synthetic construct
gtgctttatatgactagtggcattgtgcta

SEQ ID NO: 12101 - DNA, 27 bp, Artificial Sequence
  Synthetic construct
tactctgcggctgacaacaatctggta

SEQ ID NO: 12102 - DNA, 27 bp, Artificial Sequence
  Synthetic construct
atgcaagctctacaaactcctttcact

SEQ ID NO: 12103 - DNA, 27 bp, Artificial Sequence
  Synthetic construct
atgcaagctctacaaactccttgggct

SEQ ID NO: 12104 - DNA, 27 bp, Artificial Sequence
  Synthetic construct
caacagtatgatgatctccctctcact

SEQ ID NO: 12105 - DNA, 27 bp, Artificial Sequence
  Synthetic construct
caacagtatgataatatccctctgacg

SEQ ID NO: 12106 - DNA, 27 bp, Artificial Sequence
  Synthetic construct
cgacagacttacagtaccccgtacact

SEQ ID NO: 12107 - DNA, 27 bp, Artificial Sequence
  Synthetic construct
cagcagcgtatcaactggccgctcacc

SEQ ID NO: 12108 - DNA, 27 bp, Artificial Sequence
  Synthetic construct
caacagagttacagtacccctccaagt

SEQ ID NO: 12109 - DNA, 27 bp, Artificial Sequence
  Synthetic construct
atgcagggcacacactggccttggacg

SEQ ID NO: 12110 - DNA, 33 bp, Artificial Sequence
  Synthetic construct
caggtctgggattttaatagtgatcatgcactg

SEQ ID NO: 12111 - DNA, 30 bp, Artificial Sequence
  Synthetic construct
cagtcttatgataacaattttgattgggtt

SEQ ID NO: 12112 - DNA, 18 bp, Artificial Sequence
  Synthetic construct
caataccccccgaggacg

SEQ ID NO: 12113 - DNA, 30 bp, Artificial Sequence
  Synthetic construct
cagcactataacattgggcacggccacact

SEQ ID NO: 12114 - DNA, 27 bp, Artificial Sequence
  Synthetic construct
cagcaatattatagtgccccgtggacg

SEQ ID NO: 12115 - DNA, 36 bp, Artificial Sequence
  Synthetic construct
caggtgtgggacattagtgatgagcatccttatgtc

SEQ ID NO: 12116 - DNA, 27 bp, Artificial Sequence
  Synthetic construct
caacagggttacagtaccccgttcacc

SEQ ID NO: 12117 - DNA, 27 bp, Artificial Sequence
  Synthetic construct
cagtcttattatggcggcaatcaggtg

SEQ ID NO: 12118 - DNA, 33 bp, Artificial Sequence
  Synthetic construct
ggtacatggcacagcaactctaagactcgagtg

SEQ ID NO: 12119 - DNA, 33 bp, Artificial Sequence
  Synthetic construct
gcagcttgggatgacagcctgaatggtgtagtc

SEQ ID NO: 12120 - DNA, 30 bp, Artificial Sequence
  Synthetic construct
caacagtattataatttcctccctctcact

SEQ ID NO: 12121 - DNA, 27 bp, Artificial Sequence
  Synthetic construct
cagcagtatggtacctcactgttcact

SEQ ID NO: 12122 - DNA, 36 bp, Artificial Sequence
  Synthetic construct
ggaacatgggatagcagcctgagtgcaccttgggtg

SEQ ID NO: 12123 - DNA, 27 bp, Artificial Sequence
  Synthetic construct
ctgcaggctaacactatgcctctcact

SEQ ID NO: 12124 - DNA, 30 bp, Artificial Sequence
  Synthetic construct
caacaatattatactacttctgctctcact

SEQ ID NO: 12125 - DNA, 30 bp, Artificial Sequence
  Synthetic construct
cagtcttttgatagcacttctcactgggtg

SEQ ID NO: 12126 - DNA, 33 bp, Artificial Sequence
  Synthetic construct
caagtttacgataggaatactgatcaatgggta

SEQ ID NO: 12127 - DNA, 33 bp, Artificial Sequence
  Synthetic construct
aactcccgggacagcagtggtaaccatcaggtc

SEQ ID NO: 12128 - DNA, 27 bp, Artificial Sequence
  Synthetic construct
caacagtatcatacttcttcggaaacc

SEQ ID NO: 12129 - DNA, 30 bp, Artificial Sequence
  Synthetic construct
caacaatactatactttttcttcgtggacg

SEQ ID NO: 12130 - DNA, 24 bp, Artificial Sequence
  Synthetic construct
caacagtatgataatttgtggtcg

SEQ ID NO: 12131 - DNA, 30 bp, Artificial Sequence
  Synthetic construct
atgcaaggaacacactggcctccgtggacg

SEQ ID NO: 12132 - DNA, 30 bp, Artificial Sequence
  Synthetic construct
caacagtataatacttattcggggtggacg

SEQ ID NO: 12133 - DNA, 27 bp, Artificial Sequence
  Synthetic construct
ctacagtacaaaaattaccctcgcacg

SEQ ID NO: 12134 - DNA, 30 bp, Artificial Sequence
  Synthetic construct
caatcagcggacagcagtggtacttgggtc

SEQ ID NO: 12135 - DNA, 33 bp, Artificial Sequence
  Synthetic construct
cagtcgcatgacagcagcctgactaatttcatc

SEQ ID NO: 12136 - DNA, 24 bp, Artificial Sequence
  Synthetic construct
cagcagcgtaccgactggtacact

SEQ ID NO: 12137 - DNA, 27 bp, Artificial Sequence
  Synthetic construct
caacagacttacagtatcccattcact

SEQ ID NO: 12138 - DNA, 30 bp, Artificial Sequence
  Synthetic construct
cagcagcgtgtcaactggccgtatctcact

SEQ ID NO: 12139 - DNA, 30 bp, Artificial Sequence
  Synthetic construct
agctcatatacaagcagcagcacttttgtc

SEQ ID NO: 12140 - DNA, 27 bp, Artificial Sequence
  Synthetic construct
caacaatatgaaagttacccgtacact

SEQ ID NO: 12141 - DNA, 27 bp, Artificial Sequence
  Synthetic construct
atgcaagcttcacaatttcctctcact

SEQ ID NO: 12142 - DNA, 30 bp, Artificial Sequence
  Synthetic construct
cagcagtatgataagtggcctccgtggacg

SEQ ID NO: 12143 - DNA, 30 bp, Artificial Sequence
  Synthetic construct
agctcatatacaagcatcagcactgtggta

SEQ ID NO: 12144 - DNA, 30 bp, Artificial Sequence
  Synthetic construct
caacagtataattattggcctccgtacact

SEQ ID NO: 12145 - DNA, 27 bp, Artificial Sequence
  Synthetic construct
atgcaagctctacaaactccgtacact

SEQ ID NO: 12146 - DNA, 27 bp, Artificial Sequence
  Synthetic construct
cagcagcgtagcagctggcctctcact

SEQ ID NO: 12147 - DNA, 30 bp, Artificial Sequence
  Synthetic construct
aactcatatacaaacagcagcactctggtg

SEQ ID NO: 12148 - DNA, 33 bp, Artificial Sequence
  Synthetic construct
ggaacatgggatagcagcctgagtgcttatgtc

SEQ ID NO: 12149 - DNA, 30 bp, Artificial Sequence
  Synthetic construct
caacagagttacagtacccctcggagcacc

SEQ ID NO: 12150 - DNA, 24 bp, Artificial Sequence
  Synthetic construct
cagcagcgtagcaactggcctctt

SEQ ID NO: 12151 - DNA, 33 bp, Artificial Sequence
  Synthetic construct
caggcgtgggacagcagcactgccccttatgtc

SEQ ID NO: 12152 - DNA, 30 bp, Artificial Sequence
  Synthetic construct
agctcatatacaagcagcagcacttgggtg

SEQ ID NO: 12153 - DNA, 27 bp, Artificial Sequence
  Synthetic construct
caacagggtaccagtttccccttcact

SEQ ID NO: 12154 - DNA, 33 bp, Artificial Sequence
  Synthetic construct
cagttgtgggatagtcgtagtgatcatgtggta

SEQ ID NO: 12155 - DNA, 18 bp, Artificial Sequence
  Synthetic construct
cagcagcgtgacttcact

SEQ ID NO: 12156 - DNA, 27 bp, Artificial Sequence
  Synthetic construct
caacaggttaatgcttaccccttcagt

SEQ ID NO: 12157 - DNA, 27 bp, Artificial Sequence
  Synthetic construct
caccagtatgataactggcctctcact

SEQ ID NO: 12158 - DNA, 30 bp, Artificial Sequence
  Synthetic construct
cagtcttgtgataacaacaatcatggagtc

SEQ ID NO: 12159 - DNA, 27 bp, Artificial Sequence
  Synthetic construct
cagcagtattatgatgaccccctcact

SEQ ID NO: 12160 - DNA, 33 bp, Artificial Sequence
  Synthetic construct
ggaacatgggatagcagcctgagtgctgaggtc

SEQ ID NO: 12161 - DNA, 27 bp, Artificial Sequence
  Synthetic construct
cagcagtattacacttcccctctgact

SEQ ID NO: 12162 - DNA, 27 bp, Artificial Sequence
  Synthetic construct
caggcgtgggacagcagcactgccgtt

SEQ ID NO: 12163 - DNA, 30 bp, Artificial Sequence
  Synthetic construct
caacagtataatagttattttccttggacg

SEQ ID NO: 12164 - DNA, 27 bp, Artificial Sequence
  Synthetic construct
caacagagttttagtaggcctccaact

SEQ ID NO: 12165 - DNA, 30 bp, Artificial Sequence
  Synthetic construct
tgctcatatgcaggtagtagaacttctttc

SEQ ID NO: 12166 - DNA, 27 bp, Artificial Sequence
  Synthetic construct
cagcagcgtggcaactggccgatcacc

SEQ ID NO: 12167 - DNA, 33 bp, Artificial Sequence
  Synthetic construct
acctcatatacaaacaacagctattctcaggta

SEQ ID NO: 12168 - DNA, 27 bp, Artificial Sequence
  Synthetic construct
caacagagttacagtgcccctcgtact

SEQ ID NO: 12169 - DNA, 36 bp, Artificial Sequence
  Synthetic construct
ggaacatgggataacagcctgagtgctggctatgtc

SEQ ID NO: 12170 - DNA, 27 bp, Artificial Sequence
  Synthetic construct
cagcaatattatactactcctctgacg

SEQ ID NO: 12171 - DNA, 30 bp, Artificial Sequence
  Synthetic construct
atctcatatacaactagcagcacttgggtg

SEQ ID NO: 12172 - DNA, 27 bp, Artificial Sequence
  Synthetic construct
caaacgtgggacagcaccactgcggtg

SEQ ID NO: 12173 - DNA, 27 bp, Artificial Sequence
  Synthetic construct
atgcaaggttcacactggccattcact

SEQ ID NO: 12174 - DNA, 27 bp, Artificial Sequence
  Synthetic construct
cagcaatattatagtactctgtacact

SEQ ID NO: 12175 - DNA, 27 bp, Artificial Sequence
  Synthetic construct
cagcagcgtagcaactggccttggact

SEQ ID NO: 12176 - DNA, 24 bp, Artificial Sequence
  Synthetic construct
cagcaatattatagttctatcacc

SEQ ID NO: 12177 - DNA, 33 bp, Artificial Sequence
  Synthetic construct
caatcagcagacagcagtggtactttcgtggta

SEQ ID NO: 12178 - DNA, 27 bp, Artificial Sequence
  Synthetic construct
cagcaatattatagtactccattcact

SEQ ID NO: 12179 - DNA, 27 bp, Artificial Sequence
  Synthetic construct
cagcagtataataactggcccctcact

SEQ ID NO: 12180 - DNA, 27 bp, Artificial Sequence
  Synthetic construct
caacagtatgataatctccctcaaact

SEQ ID NO: 12181 - DNA, 30 bp, Artificial Sequence
  Synthetic construct
caatcagcagacagcagtggtacttatgtc

SEQ ID NO: 12182 - DNA, 30 bp, Artificial Sequence
  Synthetic construct
caacagtatgataatctccctccgctcact

SEQ ID NO: 12183 - DNA, 27 bp, Artificial Sequence
  Synthetic construct
caacagtatgataatctccctctcact

SEQ ID NO: 12184 - DNA, 30 bp, Artificial Sequence
  Synthetic construct
cagcagtatgataactggcctccgatcacc

SEQ ID NO: 12185 - DNA, 27 bp, Artificial Sequence
  Synthetic construct
gtgctgtatctgggtactgtcgtgctc

SEQ ID NO: 12186 - DNA, 24 bp, Artificial Sequence
  Synthetic construct
caacaatatgatactctgtggacg

SEQ ID NO: 12187 - DNA, 27 bp, Artificial Sequence
  Synthetic construct
caaaagtataacagtgccccgtacact

SEQ ID NO: 12188 - DNA, 27 bp, Artificial Sequence
  Synthetic construct
ctgctctcctatagtgatactcgggtc

SEQ ID NO: 12189 - DNA, 24 bp, Artificial Sequence
  Synthetic construct
cagcaatttcatacttcttggacg

SEQ ID NO: 12190 - DNA, 33 bp, Artificial Sequence
  Synthetic construct
caatcagcagacagcagtggtacttattgggtg

SEQ ID NO: 12191 - DNA, 30 bp, Artificial Sequence
  Synthetic construct
atgcaagatgcacaagatcctccgtacact

SEQ ID NO: 12192 - DNA, 27 bp, Artificial Sequence
  Synthetic construct
caacagagttacagtagtcctcggacg

SEQ ID NO: 12193 - DNA, 27 bp, Artificial Sequence
  Synthetic construct
caacaggccagcagtttcccattcact

SEQ ID NO: 12194 - DNA, 27 bp, Artificial Sequence
  Synthetic construct
caacagagttacagtaccccattcact

SEQ ID NO: 12195 - DNA, 27 bp, Artificial Sequence
  Synthetic construct
cagcagtattctagtactccattcact

SEQ ID NO: 12196 - DNA, 30 bp, Artificial Sequence
  Synthetic construct
aactcatatgcaggcagcgacaattgggtg

SEQ ID NO: 12197 - DNA, 24 bp, Artificial Sequence
  Synthetic construct
cagcagtatcatttctggccttcg

SEQ ID NO: 12198 - DNA, 33 bp, Artificial Sequence
  Synthetic construct
gcagcatgggatgacagcctgagtggttgggtg

SEQ ID NO: 12199 - DNA, 27 bp, Artificial Sequence
  Synthetic construct
atgcaagctctacaaacccagatcacc

SEQ ID NO: 12200 - DNA, 30 bp, Artificial Sequence
  Synthetic construct
cagcagtatggtagctcaccgcagatcacc

SEQ ID NO: 12201 - DNA, 30 bp, Artificial Sequence
  Synthetic construct
agctcatatgcaagcgacaccagtctggtg

SEQ ID NO: 12202 - DNA, 27 bp, Artificial Sequence
  Synthetic construct
cagcagtatggtagctcactgtggacg

SEQ ID NO: 12203 - DNA, 27 bp, Artificial Sequence
  Synthetic construct
cagcaatttaatctttatcccctcact

SEQ ID NO: 12204 - DNA, 33 bp, Artificial Sequence
  Synthetic construct
aactcccgggacagcagtggtaaccatgtggta

SEQ ID NO: 12205 - DNA, 33 bp, Artificial Sequence
  Synthetic construct
gcagcatgggatgacagcctgaatggtgtggta

SEQ ID NO: 12206 - DNA, 33 bp, Artificial Sequence
  Synthetic construct
aactcatacacaagcaccaccactcttgtactt

SEQ ID NO: 12207 - DNA, 27 bp, Artificial Sequence
  Synthetic construct
caccagtatggtgactcaccgtggacg

SEQ ID NO: 12208 - DNA, 27 bp, Artificial Sequence
  Synthetic construct
caacagtataatgcttatccgatcacc

SEQ ID NO: 12209 - DNA, 33 bp, Artificial Sequence
  Synthetic construct
caggtgtgggatactgcttctgatcattatgtc

SEQ ID NO: 12210 - DNA, 27 bp, Artificial Sequence
  Synthetic construct
cagcagtataataactggccccggacg

SEQ ID NO: 12211 - DNA, 30 bp, Artificial Sequence
  Synthetic construct
cagcagtacaataattggcctccttacact

SEQ ID NO: 12212 - DNA, 27 bp, Artificial Sequence
  Synthetic construct
tgctcatatgcaggcgctacttatgtc

SEQ ID NO: 12213 - DNA, 27 bp, Artificial Sequence
  Synthetic construct
cagcaatattatactactcccctcact

SEQ ID NO: 12214 - DNA, 33 bp, Artificial Sequence
  Synthetic construct
caggtgtgggacagtattagtaatcaggtgatt

SEQ ID NO: 12215 - DNA, 30 bp, Artificial Sequence
  Synthetic construct
cagcagtatcatgcgtggcccccgctcacc

SEQ ID NO: 12216 - DNA, 33 bp, Artificial Sequence
  Synthetic construct
cagcagtacagtaagtggcctccggggttcact

SEQ ID NO: 12217 - DNA, 33 bp, Artificial Sequence
  Synthetic construct
caacagcgaagcaactggcctccgagtctcact

SEQ ID NO: 12218 - DNA, 24 bp, Artificial Sequence
  Synthetic construct
cagcagtacaatagagggtggacg

SEQ ID NO: 12219 - DNA, 27 bp, Artificial Sequence
  Synthetic construct
caacagagttacaatatacccctcact

SEQ ID NO: 12220 - DNA, 33 bp, Artificial Sequence
  Synthetic construct
ggaacatgggatagcagcctgagtgctggactc

SEQ ID NO: 12221 - DNA, 24 bp, Artificial Sequence
  Synthetic construct
caacagagttacaatgtcccgacg

SEQ ID NO: 12222 - DNA, 27 bp, Artificial Sequence
  Synthetic construct
caacagtataatcattaccctttcacc

SEQ ID NO: 12223 - DNA, 27 bp, Artificial Sequence
  Synthetic construct
caccagtattatagtactccgtccact

SEQ ID NO: 12224 - DNA, 27 bp, Artificial Sequence
  Synthetic construct
caacagtttaatagttacacgtggacg

SEQ ID NO: 12225 - DNA, 30 bp, Artificial Sequence
  Synthetic construct
caggcgtgggacagcagttccctttatgtc

SEQ ID NO: 12226 - DNA, 33 bp, Artificial Sequence
  Synthetic construct
caacaggggaccgactggcctcacctattcact

SEQ ID NO: 12227 - DNA, 24 bp, Artificial Sequence
  Synthetic construct
cagcagcatttcagctggatcacc

SEQ ID NO: 12228 - DNA, 27 bp, Artificial Sequence
  Synthetic construct
atgcagggcacacactggccgctcact

SEQ ID NO: 12229 - DNA, 27 bp, Artificial Sequence
  Synthetic construct
caacagagtttcagaaccccgtacact

SEQ ID NO: 12230 - DNA, 33 bp, Artificial Sequence
  Synthetic construct
gccacatgggacgacagcctgactggctatgtc

SEQ ID NO: 12231 - DNA, 33 bp, Artificial Sequence
  Synthetic construct
tcagcatgggacagcagcctcagtgcttgggtg

SEQ ID NO: 12232 - DNA, 27 bp, Artificial Sequence
  Synthetic construct
caacagtatagtagttatccgttcacg

SEQ ID NO: 12233 - DNA, 33 bp, Artificial Sequence
  Synthetic construct
tcttcatacataagaggcaccgcttcttttgtc

SEQ ID NO: 12234 - DNA, 30 bp, Artificial Sequence
  Synthetic construct
cagcactatagtgactggcctccggtaact

SEQ ID NO: 12235 - DNA, 27 bp, Artificial Sequence
  Synthetic construct
atgcaaactctccaagctccgtacact

SEQ ID NO: 12236 - DNA, 27 bp, Artificial Sequence
  Synthetic construct
caacaggctaacagtttcccgatcacc

SEQ ID NO: 12237 - DNA, 30 bp, Artificial Sequence; identical to SEQ ID NO: 1881
  Synthetic construct

SEQ ID NO: 12238 - DNA, 27 bp, Artificial Sequence
  Synthetic construct
ctccagcacaatagtttcccgctcact

SEQ ID NO: 12239 - DNA, 27 bp, Artificial Sequence
  Synthetic construct
caacagtatgaaaatctcccactcact

SEQ ID NO: 12240 - DNA, 24 bp, Artificial Sequence
  Synthetic construct
atgcaaggtctacaaactccgact

SEQ ID NO: 12241 - DNA, 27 bp, Artificial Sequence
  Synthetic construct
cagcaatattctagtactctttggaca

SEQ ID NO: 12242 - DNA, 33 bp, Artificial Sequence
  Synthetic construct
agctcatatgcaaccagcgacaatttaagattg

SEQ ID NO: 12243 - DNA, 24 bp, Artificial Sequence
  Synthetic construct
cagcaatattttattactccgact

SEQ ID NO: 12244 - DNA, 30 bp, Artificial Sequence
  Synthetic construct
caagaatataatagttaccctatgtacact

SEQ ID NO: 12245 - DNA, 27 bp, Artificial Sequence
  Synthetic construct
caacagtacagtacttatttcgtcact

SEQ ID NO: 12246 - DNA, 27 bp, Artificial Sequence
  Synthetic construct
caacagagttacagtcccccgttcact

SEQ ID NO: 12247 - DNA, 36 bp, Artificial Sequence
  Synthetic construct
caggtgtgggatagtactggtgttcacccttttgtc

SEQ ID NO: 12248 - DNA, 33 bp, Artificial Sequence
  Synthetic construct
ggaacgtgggatgacagcctgaatgctggcgtc

SEQ ID NO: 12249 - DNA, 27 bp, Artificial Sequence
  Synthetic construct
cagctgtattttggttcaggattcact

SEQ ID NO: 12250 - DNA, 27 bp, Artificial Sequence
  Synthetic construct
cagcagtatggcagatcccctcggacg

SEQ ID NO: 12251 - DNA, 27 bp, Artificial Sequence
  Synthetic construct
atgcaacctctacagctcccagacact

SEQ ID NO: 12252 - DNA, 30 bp, Artificial Sequence
  Synthetic construct
agctcatatgcaggcactaacaattttgtc

SEQ ID NO: 12253 - DNA, 27 bp, Artificial Sequence
  Synthetic construct
caacaatatggtaattcacctcagacg

SEQ ID NO: 12254 - DNA, 27 bp, Artificial Sequence
  Synthetic construct
caccagtattatgcgaccccatacacc

SEQ ID NO: 12255 - DNA, 27 bp, Artificial Sequence
  Synthetic construct
caacagagtttcagacccccgctcact

SEQ ID NO: 12256 - DNA, 30 bp, Artificial Sequence
  Synthetic construct
cagcagcgtagcagctggcctccgatcacc

SEQ ID NO: 12257 - DNA, 33 bp, Artificial Sequence
  Synthetic construct
caggtgtgggatagtagtgttgatcccgtgata

SEQ ID NO: 12258 - DNA, 33 bp, Artificial Sequence
  Synthetic construct
ggaacatgggatgctagcgtgagtgttgcggta

SEQ ID NO: 12259 - DNA, 33 bp, Artificial Sequence
  Synthetic construct
ggagcatgggatagcagcctgaatgttgtggtg

SEQ ID NO: 12260 - DNA, 27 bp, Artificial Sequence
  Synthetic construct
caacaatattataatattccttggacg

SEQ ID NO: 12261 - DNA, 33 bp, Artificial Sequence
  Synthetic construct
gcagcatgggatggcagcctgaatggttatgtc

SEQ ID NO: 12262 - DNA, 33 bp, Artificial Sequence
  Synthetic construct
caacaatatgagaacatccctccggggctcacg

SEQ ID NO: 12263 - DNA, 33 bp, Artificial Sequence
  Synthetic construct
agctcatatgaaaccagcaacaatttgaggtta

SEQ ID NO: 12264 - DNA, 27 bp, Artificial Sequence
  Synthetic construct
cagcagtatggtagctcacctgggacg

SEQ ID NO: 12265 - DNA, 27 bp, Artificial Sequence
  Synthetic construct
cagcagtatggcatctcaccgtacact

SEQ ID NO: 12266 - DNA, 30 bp, Artificial Sequence
  Synthetic construct
atgcaagatgcacaagatcccttgttcact

SEQ ID NO: 12267 - DNA, 27 bp, Artificial Sequence
  Synthetic construct
cagcagtctggtagctcaccgtacact

SEQ ID NO: 12268 - DNA, 27 bp, Artificial Sequence
  Synthetic construct
caacaatattttcgtactcctccgact

SEQ ID NO: 12269 - DNA, 24 bp, Artificial Sequence
  Synthetic construct
caacagagttacacttccctcact

SEQ ID NO: 12270 - DNA, 27 bp, Artificial Sequence
  Synthetic construct
caacaggttgatgctgacccgatcacc

SEQ ID NO: 12271 - DNA, 33 bp, Artificial Sequence
  Synthetic construct
ggaacatgggatagcagtttgagtggtggggtg

SEQ ID NO: 12272 - DNA, 33 bp, Artificial Sequence
  Synthetic construct
gcctcatataccgttagtagtagtctcgaggtc

SEQ ID NO: 12273 - DNA, 27 bp, Artificial Sequence
  Synthetic construct
caacaagcaaacagtttccctcacacg

SEQ ID NO: 12274 - DNA, 33 bp, Artificial Sequence
  Synthetic construct
gcagcatgggatgacagcctgagtggtccggta

SEQ ID NO: 12275 - DNA, 27 bp, Artificial Sequence
  Synthetic construct
atgcaaaataaacaggtttccataacc

SEQ ID NO: 12276 - DNA, 33 bp, Artificial Sequence
  Synthetic construct
ggaacatgggataacagcctgagtgcttgggtg

SEQ ID NO: 12277 - DNA, 33 bp, Artificial Sequence
  Synthetic construct
gcagcatgggatgacagcctgaatggttatgtc

SEQ ID NO: 12278 - DNA, 27 bp, Artificial Sequence
  Synthetic construct
caccagtatgataagtctccctacact

SEQ ID NO: 12279 - DNA, 30 bp, Artificial Sequence
  Synthetic construct
ctacaacatgataatttccctctcggctct

SEQ ID NO: 12280 - DNA, 30 bp, Artificial Sequence
  Synthetic construct
caacagagtcacagttcctctccgtggacg

SEQ ID NO: 12281 - DNA, 27 bp, Artificial Sequence
  Synthetic construct
atgcaagctctacaaactccgtggacg

SEQ ID NO: 12282 - DNA, 33 bp, Artificial Sequence
  Synthetic construct
cagtcctatgacagcagcctgagtggttgggtg

SEQ ID NO: 12283 - DNA, 27 bp, Artificial Sequence
  Synthetic construct
caacaatattatgatacccctcggacg

SEQ ID NO: 12284 - DNA, 27 bp, Artificial Sequence
  Synthetic construct
cttcagcacaatggttaccctcggtcg

SEQ ID NO: 12285 - DNA, 33 bp, Artificial Sequence
  Synthetic construct
cagtcactagacagtagtggtgtttatgtggta

SEQ ID NO: 12286 - DNA, 27 bp, Artificial Sequence
  Synthetic construct
caacagtattttgatctccgtttcggt

SEQ ID NO: 12287 - DNA, 27 bp, Artificial Sequence
  Synthetic construct
agctcgtatacaagcaacattatttta

SEQ ID NO: 12288 - DNA, 27 bp, Artificial Sequence
  Synthetic construct
cagcagactaccagtttccctctcact

SEQ ID NO: 12289 - DNA, 27 bp, Artificial Sequence
  Synthetic construct
cagcactttaacggttctcctctcact

SEQ ID NO: 12290 - DNA, 36 bp, Artificial Sequence
  Synthetic construct
caggtgtgggacagtagtagtgatcacccctatgtc

SEQ ID NO: 12291 - DNA, 27 bp, Artificial Sequence
  Synthetic construct
caacagcttaatagttacccgctcact

SEQ ID NO: 12292 - DNA, 30 bp, Artificial Sequence
  Synthetic construct
aactcatatacaagcagcagcacttatgtc

SEQ ID NO: 12293 - DNA, 27 bp, Artificial Sequence
  Synthetic construct
caacactataatgactggcaaatcact

SEQ ID NO: 12294 - DNA, 27 bp, Artificial Sequence
  Synthetic construct
gaacagacctatagtattccgtggact

SEQ ID NO: 12295 - DNA, 27 bp, Artificial Sequence
  Synthetic construct
cagcagcgtttcaagtggcccatcacc

SEQ ID NO: 12296 - DNA, 33 bp, Artificial Sequence
  Synthetic construct
cagtcctttgacgacagcctgaatgcttcgctg

SEQ ID NO: 12297 - DNA, 33 bp, Artificial Sequence
  Synthetic construct
aactgccgagacaccagtggtgacccttgggtg

SEQ ID NO: 12298 - DNA, 30 bp, Artificial Sequence
  Synthetic construct
cagcagcgtagcaactggccctcggtcact

SEQ ID NO: 12299 - DNA, 27 bp, Artificial Sequence
  Synthetic construct
acgcaagctacacaattcccctacact

SEQ ID NO: 12300 - DNA, 27 bp, Artificial Sequence
  Synthetic construct
caacaggctaacagtttacctctcact

SEQ ID NO: 12301 - DNA, 27 bp, Artificial Sequence
  Synthetic construct
catcaaagtagtagtttaccgtacact

SEQ ID NO: 12302 - DNA, 27 bp, Artificial Sequence
  Synthetic construct
cagcagtatggtagttcacctcggacg

SEQ ID NO: 12303 - DNA, 15 bp, Artificial Sequence
  Synthetic construct
caacagagtggcact

SEQ ID NO: 12304 - DNA, 24 bp, Artificial Sequence
  Synthetic construct
caacagtatcattcttattcgacg

SEQ ID NO: 12305 - DNA, 33 bp, Artificial Sequence
  Synthetic construct
caggagtataatagctggcctccggagtacgct

SEQ ID NO: 12306 - DNA, 33 bp, Artificial Sequence
  Synthetic construct
cagcagtatggtagctcacctccgatgtacacc

SEQ ID NO: 12307 - DNA, 27 bp, Artificial Sequence
  Synthetic construct
caacagttttttcgaaccccgtacact

SEQ ID NO: 12308 - DNA, 24 bp, Artificial Sequence
  Synthetic construct
atgatttggtcagacgcgtatgtc

SEQ ID NO: 12309 - DNA, 27 bp, Artificial Sequence
  Synthetic construct
caacagtatgatgatcttccgctcact

SEQ ID NO: 12310 - DNA, 27 bp, Artificial Sequence
  Synthetic construct
caacaggctgacaatttgccgtggacg

SEQ ID NO: 12311 - DNA, 33 bp, Artificial Sequence
  Synthetic construct
cagcagcgtagcgactggcctccggtgtacact

SEQ ID NO: 12312 - DNA, 33 bp, Artificial Sequence
  Synthetic construct
gccgcttgggacgaccacctgcgaattgtgggt

SEQ ID NO: 12313 - DNA, 33 bp, Artificial Sequence
  Synthetic construct
caggtgtgggatagtagtagtgatccccgggtg

SEQ ID NO: 12314 - DNA, 27 bp, Artificial Sequence
  Synthetic construct
cagcaatattatagtactccgtggacg

SEQ ID NO: 12315 - DNA, 33 bp, Artificial Sequence
  Synthetic construct
gcagcatgggatgacagcctgaatggtcccgtc

SEQ ID NO: 12316 - DNA, 33 bp, Artificial Sequence
  Synthetic construct
cagtcctatgacaacagcctgagtggttatgtc

SEQ ID NO: 12317 - DNA, 33 bp, Artificial Sequence
  Synthetic construct
gtcgtttgggatgtcagactgagtgggtatgtc

SEQ ID NO: 12318 - DNA, 27 bp, Artificial Sequence
  Synthetic construct
caacaggctaacagtttcccctacact

SEQ ID NO: 12319 - DNA, 27 bp, Artificial Sequence
  Synthetic construct
caacagggttacagtaccccattcact

SEQ ID NO: 12320 - DNA, 33 bp, Artificial Sequence
  Synthetic construct
caggtgtgggatagtattagtgagcatcaagtg

SEQ ID NO: 12321 - DNA, 33 bp, Artificial Sequence
  Synthetic construct
ggagcctgggacagcagcctgagagcggtggtg

SEQ ID NO: 12322 - DNA, 27 bp, Artificial Sequence
  Synthetic construct
caacagtattatagtctccctctcact

SEQ ID NO: 12323 - DNA, 27 bp, Artificial Sequence
  Synthetic construct
cagcagtatagttcctcacctcggacg

SEQ ID NO: 12324 - DNA, 27 bp, Artificial Sequence
  Synthetic construct
atgcaaagtctacagactccgccgacg

SEQ ID NO: 12325 - DNA, 27 bp, Artificial Sequence
  Synthetic construct
caacagagtttcagctccctttggacg

SEQ ID NO: 12326 - DNA, 30 bp, Artificial Sequence
  Synthetic construct
agctcctatacaagcggtcgtattctggtt

SEQ ID NO: 12327 - DNA, 27 bp, Artificial Sequence
  Synthetic construct
atgcaaactctacaaactcctctcact

SEQ ID NO: 12328 - DNA, 27 bp, Artificial Sequence
  Synthetic construct
caacagtattatagttaccccctcact

SEQ ID NO: 12329 - DNA, 33 bp, Artificial Sequence
  Synthetic construct
aactcccgggacagcagtggtaaccattgggtg

SEQ ID NO: 12330 - DNA, 33 bp, Artificial Sequence
  Synthetic construct
ggaacatgggatagcagcctgagtgctgtggta

SEQ ID NO: 12331 - DNA, 33 bp, Artificial Sequence
  Synthetic construct
ggaacatgggatagcagcctgagtgctaaagta

SEQ ID NO: 12332 - DNA, 30 bp, Artificial Sequence
  Synthetic construct
caacagagttacagtacccccccgtacact

SEQ ID NO: 12333 - DNA, 27 bp, Artificial Sequence
  Synthetic construct
caacagagttacagtacccctagaacg

SEQ ID NO: 12334 - DNA, 24 bp, Artificial Sequence
  Synthetic construct
caacagtatgattatatccctcgc

SEQ ID NO: 12335 - DNA, 24 bp, Artificial Sequence
  Synthetic construct
caacaatattattcttactctacg

SEQ ID NO: 12336 - DNA, 27 bp, Artificial Sequence
  Synthetic construct
cagcaatattttagtactccgtacact

SEQ ID NO: 12337 - DNA, 30 bp, Artificial Sequence
  Synthetic construct
cagcagcgtagcacctggcctccggggact

SEQ ID NO: 12338 - DNA, 27 bp, Artificial Sequence
  Synthetic construct
caacaatatgagagttatccgatcact

SEQ ID NO: 12339 - DNA, 27 bp, Artificial Sequence
  Synthetic construct
caacattattataattaccctttcact

SEQ ID NO: 12340 - DNA, 27 bp, Artificial Sequence
  Synthetic construct
ctacagcataatagttaccctcggacg

SEQ ID NO: 12341 - DNA, 27 bp, Artificial Sequence
  Synthetic construct
caacaatattataatactccgtacact

SEQ ID NO: 12342 - DNA, 27 bp, Artificial Sequence
  Synthetic construct
cagcagtataataactggcctcacact

SEQ ID NO: 12343 - DNA, 27 bp, Artificial Sequence
  Synthetic construct
cagacctggggcaaaggcattcaggtg

SEQ ID NO: 12344 - DNA, 33 bp, Artificial Sequence
  Synthetic construct
cagtcctatgacaacagcctgagaacttcggtg

SEQ ID NO: 12345 - DNA, 27 bp, Artificial Sequence
  Synthetic construct
caccaatataaaaacgcggggtggacg

SEQ ID NO: 12346 - DNA, 27 bp, Artificial Sequence
  Synthetic construct
cagcagcgtgacacctggccttggacg

SEQ ID NO: 12347 - DNA, 27 bp, Artificial Sequence
  Synthetic construct
caacagtttaatagttaccctcgcact

SEQ ID NO: 12348 - DNA, 27 bp, Artificial Sequence
  Synthetic construct
ctgctctactatggtggtgcttgggtg

SEQ ID NO: 12349 - DNA, 27 bp, Artificial Sequence
  Synthetic construct
cagcagtatggtagctcacttatcacc

SEQ ID NO: 12350 - DNA, 27 bp, Artificial Sequence
  Synthetic construct
cagcagtatggtagctcacctctcact

SEQ ID NO: 12351 - DNA, 27 bp, Artificial Sequence
  Synthetic construct
caacagtataatagttatccgtacact

SEQ ID NO: 12352 - DNA, 27 bp, Artificial Sequence
  Synthetic construct
caacagtattatagtttcccgctcact

SEQ ID NO: 12353 - DNA, 27 bp, Artificial Sequence
  Synthetic construct
caacagtataatagttatttgtggacg

SEQ ID NO: 12354 - DNA, 30 bp, Artificial Sequence
  Synthetic construct
cagcagtatggtagctcaccactattcact

SEQ ID NO: 12355 - DNA, 33 bp, Artificial Sequence
  Synthetic construct
aactcccgggacagcagtggtaaccatgtggtc

SEQ ID NO: 12356 - DNA, 27 bp, Artificial Sequence
  Synthetic construct
caacagtttgataatctccctatcacc

SEQ ID NO: 12357 - DNA, 27 bp, Artificial Sequence
  Synthetic construct
caacagagttacagcatcccgtacact

SEQ ID NO: 12358 - DNA, 27 bp, Artificial Sequence
  Synthetic construct
atgcaacgtatagagtttccttggacg

SEQ ID NO: 12359 - DNA, 27 bp, Artificial Sequence
  Synthetic construct
caacactataatggttatccgtggacg

SEQ ID NO: 12360 - DNA, 27 bp, Artificial Sequence
  Synthetic construct
caacagcttaatagttaccctcctcat

SEQ ID NO: 12361 - DNA, 30 bp, Artificial Sequence
  Synthetic construct
agctcatatacaagcagcagcacttatgtc

SEQ ID NO: 12362 - DNA, 27 bp, Artificial Sequence
  Synthetic construct
caacaggctaacagtttcccgtacact

SEQ ID NO: 12363 - DNA, 27 bp, Artificial Sequence
  Synthetic construct
cagcagtataataactggccgtacact

SEQ ID NO: 12364 - DNA, 27 bp, Artificial Sequence
  Synthetic construct
caacagagttacagtaccctctacact

SEQ ID NO: 12365 - DNA, 30 bp, Artificial Sequence
  Synthetic construct
cagcaatattatactactcccacgtggacg

SEQ ID NO: 12366 - DNA, 33 bp, Artificial Sequence
  Synthetic construct
caggtgtgggataacactgatgatcctgtggta

SEQ ID NO: 12367 - DNA, 27 bp, Artificial Sequence
  Synthetic construct
cagcagagtctcagtaccctgatcact

SEQ ID NO: 12368 - DNA, 27 bp, Artificial Sequence
  Synthetic construct
caacagagttacattacccctctcact

SEQ ID NO: 12369 - DNA, 30 bp, Artificial Sequence
  Synthetic construct
tcctcatacgcaagtgggggcactgtggtt

SEQ ID NO: 12370 - DNA, 27 bp, Artificial Sequence
  Synthetic construct
cagcagggtaacaactggccgctcact

SEQ ID NO: 12371 - DNA, 30 bp, Artificial Sequence
  Synthetic construct
cagacttgggacagcagcacttcttatctc

SEQ ID NO: 12372 - DNA, 30 bp, Artificial Sequence
  Synthetic construct
cagcaatattatagtgctcctccctggacg

SEQ ID NO: 12373 - DNA, 33 bp, Artificial Sequence
  Synthetic construct
gcaacatgggatgacagtctgaatgctgtggtt

SEQ ID NO: 12374 - DNA, 39 bp, Artificial Sequence
  Synthetic construct
gaagcatgggagagcagcctgagtggtggccatggggtc

SEQ ID NO: 12375 - DNA, 27 bp, Artificial Sequence
  Synthetic construct
caacaacttaatacttaccctcggact

SEQ ID NO: 12376 - DNA, 27 bp, Artificial Sequence
  Synthetic construct
caacagagttacaagttccctcggacg

SEQ ID NO: 12377 - DNA, 33 bp, Artificial Sequence
  Synthetic construct
cagtcctatgacagcagcctgagtggtgtggtt

SEQ ID NO: 12378 - DNA, 33 bp, Artificial Sequence
  Synthetic construct
caatcagcagacagcagtgattcttatagggtc

SEQ ID NO: 12379 - DNA, 27 bp, Artificial Sequence
  Synthetic construct
cagtactatggtggctcaccaaagacg

SEQ ID NO: 12380 - DNA, 24 bp, Artificial Sequence
  Synthetic construct
caacattattatagtcaaacaatg

SEQ ID NO: 12381 - DNA, 27 bp, Artificial Sequence
  Synthetic construct
caacagagtgacagtaccctgccctct

SEQ ID NO: 12382 - DNA, 27 bp, Artificial Sequence
  Synthetic construct
cagcagtatggtagctcactctggacg

SEQ ID NO: 12383 - DNA, 33 bp, Artificial Sequence
  Synthetic construct
cagtcccatgacaccagccttcctggttcggtg

SEQ ID NO: 12384 - DNA, 27 bp, Artificial Sequence
  Synthetic construct
caacagagtttcagttccgtttggacg

SEQ ID NO: 12385 - DNA, 27 bp, Artificial Sequence
  Synthetic construct
ctgcagtatgatcactggatttacact

SEQ ID NO: 12386 - DNA, 27 bp, Artificial Sequence
  Synthetic construct
atgcaaggtacacattggcctccgggc

SEQ ID NO: 12387 - DNA, 24 bp, Artificial Sequence
  Synthetic construct
cagcagcgtagcgactggctcact

SEQ ID NO: 12388 - DNA, 33 bp, Artificial Sequence
  Synthetic construct
tgctcatattcaagaggggacaccctgtatgtc

SEQ ID NO: 12389 - DNA, 27 bp, Artificial Sequence
  Synthetic construct
cagcaatattataataagcctcccact

SEQ ID NO: 12390 - DNA, 27 bp, Artificial Sequence
  Synthetic construct
caggcgtgggacagcagcactgtgcta

SEQ ID NO: 12391 - DNA, 27 bp, Artificial Sequence
  Synthetic construct
cagcaatatactctctcgcctcacaat

SEQ ID NO: 12392 - DNA, 33 bp, Artificial Sequence
  Synthetic construct
cagtcctatgacagcagcctgagtggtcatgtt

SEQ ID NO: 12393 - DNA, 27 bp, Artificial Sequence
  Synthetic construct
caacagagttacattaccccgtggacg

SEQ ID NO: 12394 - DNA, 30 bp, Artificial Sequence
  Synthetic construct
tgctcatatgcaggcagctacactttggtg

SEQ ID NO: 12395 - DNA, 27 bp, Artificial Sequence
  Synthetic construct
caacagagttacagtacccctcggact

SEQ ID NO: 12396 - DNA, 36 bp, Artificial Sequence
  Synthetic construct
caggtgtgggataatagtagtgatcatcctttagta

SEQ ID NO: 12397 - DNA, 30 bp, Artificial Sequence
  Synthetic construct
cttcaggattccaattacccttttgtcact

SEQ ID NO: 12398 - DNA, 27 bp, Artificial Sequence
  Synthetic construct
caacagtattatagttacccgtacact

SEQ ID NO: 12399 - DNA, 27 bp, Artificial Sequence
  Synthetic construct
caacagagtttcactacccctcccact

SEQ ID NO: 12400 - DNA, 27 bp, Artificial Sequence
  Synthetic construct
cagcaatatgatacgtggcctcggact

SEQ ID NO: 12401 - DNA, 33 bp, Artificial Sequence
  Synthetic construct
tgctcatatgcaggcaggaactcggggaatgtc

SEQ ID NO: 12402 - DNA, 33 bp, Artificial Sequence
  Synthetic construct
caggtgtgggacagtagtagtgatcatccggta

SEQ ID NO: 12403 - DNA, 27 bp, Artificial Sequence
  Synthetic construct
caacagtattatagttccccgtacact

SEQ ID NO: 12404 - DNA, 33 bp, Artificial Sequence
  Synthetic construct
caggtgtgggaccattctaatgatcattttgtc

SEQ ID NO: 12405 - DNA, 33 bp, Artificial Sequence
  Synthetic construct
cagtcctttgacagcagcctgagtggttttgtc

SEQ ID NO: 12406 - DNA, 33 bp, Artificial Sequence
  Synthetic construct
ggaacatgggatagcagcctgactgctggggtc

SEQ ID NO: 12407 - DNA, 27 bp, Artificial Sequence
  Synthetic construct
cagcagtatggttcctctttattcact

SEQ ID NO: 12408 - DNA, 27 bp, Artificial Sequence
  Synthetic construct
caacagagttacagtacccctccgacg

SEQ ID NO: 12409 - DNA, 27 bp, Artificial Sequence
  Synthetic construct
atgcaaggtatacaccttccgtggacg

SEQ ID NO: 12410 - DNA, 33 bp, Artificial Sequence
  Synthetic construct
cagcagtataataactggcctcccaaatacact

SEQ ID NO: 12411 - DNA, 33 bp, Artificial Sequence
  Synthetic construct
tgctcatatgcaggtagtagcactttcgtgcta

SEQ ID NO: 12412 - DNA, 30 bp, Artificial Sequence
  Synthetic construct
tgttcatattcaggcaggaacaacgatgtc

SEQ ID NO: 12413 - DNA, 33 bp, Artificial Sequence
  Synthetic construct
gcagcatgggatgacagcctgaatactaatgtc

SEQ ID NO: 12414 - DNA, 27 bp, Artificial Sequence
  Synthetic construct
cagtggagttccagtgtcttggtgacg

SEQ ID NO: 12415 - DNA, 30 bp, Artificial Sequence
  Synthetic construct
cagtcagcagacagcagtggcacttgggtg

SEQ ID NO: 12416 - DNA, 24 bp, Artificial Sequence
  Synthetic construct
caacagcgtagcaactggtggacg

SEQ ID NO: 12417 - DNA, 30 bp, Artificial Sequence
  Synthetic construct
acctcatatacaggcatctctctctatgtc

SEQ ID NO: 12418 - DNA, 24 bp, Artificial Sequence
  Synthetic construct
cagcaatatagtggttattggacg

SEQ ID NO: 12419 - DNA, 24 bp, Artificial Sequence
  Synthetic construct
cagcaatatgatacctcagggacg

SEQ ID NO: 12420 - DNA, 27 bp, Artificial Sequence
  Synthetic construct
caatcagcaaacagcagtgcctccgtc

SEQ ID NO: 12421 - DNA, 27 bp, Artificial Sequence
  Synthetic construct
cagctctatgataactcccggtacact

SEQ ID NO: 12422 - DNA, 30 bp, Artificial Sequence
  Synthetic construct
caacagcttagttcttaccctccgatcacc

SEQ ID NO: 12423 - DNA, 33 bp, Artificial Sequence
  Synthetic construct
ggaacatgggataccagcctgagtggtgtggtt

SEQ ID NO: 12424 - DNA, 27 bp, Artificial Sequence
  Synthetic construct
ctacagtataataattaccctcgcacg

SEQ ID NO: 12425 - DNA, 33 bp, Artificial Sequence
  Synthetic construct
tgttcatatgcaggtagtagccctaattatgtc

SEQ ID NO: 12426 - DNA, 33 bp, Artificial Sequence; identical to SEQ ID NO: 1882
  Synthetic construct

SEQ ID NO: 12427 - DNA, 33 bp, Artificial Sequence
  Synthetic construct
cacctgtgggatagtagtagtggtcgctgggtg

SEQ ID NO: 12428 - DNA, 30 bp, Artificial Sequence
  Synthetic construct
cagcactatggagactcagcggcgtacact

SEQ ID NO: 12429 - DNA, 27 bp, Artificial Sequence
  Synthetic construct
caacaggctgacactttcccattcaat

SEQ ID NO: 12430 - DNA, 27 bp, Artificial Sequence
  Synthetic construct
cagcagtatgctagttcacctcggacg

SEQ ID NO: 12431 - DNA, 24 bp, Artificial Sequence
  Synthetic construct
caacaatatggtagtacactcact

SEQ ID NO: 12432 - DNA, 36 bp, Artificial Sequence
  Synthetic construct
caggtgtgggatagtagttctgctcatgtttatgtc

SEQ ID NO: 12433 - DNA, 33 bp, Artificial Sequence
  Synthetic construct
tgctcatatgcaggtagcagtcttcattatgtc

SEQ ID NO: 12434 - DNA, 30 bp, Artificial Sequence
  Synthetic construct
cagtcctatgacaccagcctgagtggtgtc

SEQ ID NO: 12435 - DNA, 24 bp, Artificial Sequence
  Synthetic construct
caacaatataatagttattgcagt

SEQ ID NO: 12436 - DNA, 36 bp, Artificial Sequence; identical to SEQ ID NO: 8520
  Synthetic construct

SEQ ID NO: 12437 - DNA, 33 bp, Artificial Sequence; identical to SEQ ID NO: 8521
  Synthetic construct

SEQ ID NO: 12438 - DNA, 39 bp, Artificial Sequence; identical to SEQ ID NO: 8522
  Synthetic construct

SEQ ID NO: 12439 - DNA, 33 bp, Artificial Sequence; identical to SEQ ID NO: 8523
  Synthetic construct

SEQ ID NO: 12440 - DNA, 30 bp, Artificial Sequence; identical to SEQ ID NO: 8524
  Synthetic construct

SEQ ID NO: 12441 - DNA, 39 bp, Artificial Sequence; identical to SEQ ID NO: 8525
  Synthetic construct

SEQ ID NO: 12442 - DNA, 33 bp, Artificial Sequence; identical to SEQ ID NO: 8526
  Synthetic construct

SEQ ID NO: 12443 - DNA, 36 bp, Artificial Sequence; identical to SEQ ID NO: 8527
  Synthetic construct

SEQ ID NO: 12444 - DNA, 33 bp, Artificial Sequence; identical to SEQ ID NO: 8528
  Synthetic construct

SEQ ID NO: 12445 - DNA, 33 bp, Artificial Sequence; identical to SEQ ID NO: 8529
  Synthetic construct

SEQ ID NO: 12446 - DNA, 42 bp, Artificial Sequence; identical to SEQ ID NO: 8530
  Synthetic construct

SEQ ID NO: 12447 - DNA, 33 bp, Artificial Sequence; identical to SEQ ID NO: 8531
  Synthetic construct

SEQ ID NO: 12448 - DNA, 39 bp, Artificial Sequence; identical to SEQ ID NO: 8532
  Synthetic construct

SEQ ID NO: 12449 - DNA, 39 bp, Artificial Sequence; identical to SEQ ID NO: 8533
  Synthetic construct

SEQ ID NO: 12450 - DNA, 30 bp, Artificial Sequence; identical to SEQ ID NO: 8534
  Synthetic construct

SEQ ID NO: 12451 - DNA, 33 bp, Artificial Sequence; identical to SEQ ID NO: 8535
  Synthetic construct

SEQ ID NO: 12452 - DNA, 33 bp, Artificial Sequence; identical to SEQ ID NO: 8536
  Synthetic construct

SEQ ID NO: 12453 - DNA, 39 bp, Artificial Sequence; identical to SEQ ID NO: 8537
  Synthetic construct

SEQ ID NO: 12454 - DNA, 33 bp, Artificial Sequence; identical to SEQ ID NO: 8538
  Synthetic construct

SEQ ID NO: 12455 - DNA, 39 bp, Artificial Sequence; identical to SEQ ID NO: 8539
  Synthetic construct

SEQ ID NO: 12456 - DNA, 36 bp, Artificial Sequence; identical to SEQ ID NO: 8540
  Synthetic construct

SEQ ID NO: 12457 - DNA, 33 bp, Artificial Sequence; identical to SEQ ID NO: 8541
  Synthetic construct

SEQ ID NO: 12458 - DNA, 39 bp, Artificial Sequence; identical to SEQ ID NO: 8542
  Synthetic construct

SEQ ID NO: 12459 - DNA, 36 bp, Artificial Sequence; identical to SEQ ID NO: 8543
  Synthetic construct

SEQ ID NO: 12460 - DNA, 33 bp, Artificial Sequence; identical to SEQ ID NO: 8544
  Synthetic construct

SEQ ID NO: 12461 - DNA, 33 bp, Artificial Sequence; identical to SEQ ID NO: 8545
  Synthetic construct

SEQ ID NO: 12462 - DNA, 33 bp, Artificial Sequence; identical to SEQ ID NO: 8546
  Synthetic construct

SEQ ID NO: 12463 - DNA, 39 bp, Artificial Sequence; identical to SEQ ID NO: 8547
  Synthetic construct

SEQ ID NO: 12464 - DNA, 30 bp, Artificial Sequence; identical to SEQ ID NO: 8548
  Synthetic construct

SEQ ID NO: 12465 - DNA, 33 bp, Artificial Sequence; identical to SEQ ID NO: 8549
  Synthetic construct

SEQ ID NO: 12466 - DNA, 39 bp, Artificial Sequence; identical to SEQ ID NO: 8550
  Synthetic construct

SEQ ID NO: 12467 - DNA, 42 bp, Artificial Sequence; identical to SEQ ID NO: 8551
  Synthetic construct

SEQ ID NO: 12468 - DNA, 30 bp, Artificial Sequence; identical to SEQ ID NO: 8552
  Synthetic construct

SEQ ID NO: 12469 - DNA, 39 bp, Artificial Sequence; identical to SEQ ID NO: 8553
  Synthetic construct

SEQ ID NO: 12470 - DNA, 33 bp, Artificial Sequence; identical to SEQ ID NO: 8554
  Synthetic construct

SEQ ID NO: 12471 - DNA, 33 bp, Artificial Sequence; identical to SEQ ID NO: 8555
  Synthetic construct

SEQ ID NO: 12472 - DNA, 30 bp, Artificial Sequence; identical to SEQ ID NO: 8556
  Synthetic construct

SEQ ID NO: 12473 - DNA, 33 bp, Artificial Sequence; identical to SEQ ID NO: 8557
  Synthetic construct

SEQ ID NO: 12474 - DNA, 36 bp, Artificial Sequence; identical to SEQ ID NO: 8558
  Synthetic construct

SEQ ID NO: 12475 - DNA, 42 bp, Artificial Sequence; identical to SEQ ID NO: 8559
  Synthetic construct

SEQ ID NO: 12476 - DNA, 39 bp, Artificial Sequence; identical to SEQ ID NO: 8560
  Synthetic construct

SEQ ID NO: 12477 - DNA, 36 bp, Artificial Sequence; identical to SEQ ID NO: 8561
  Synthetic construct

SEQ ID NO: 12478 - DNA, 33 bp, Artificial Sequence; identical to SEQ ID NO: 8562
  Synthetic construct

SEQ ID NO: 12479 - DNA, 45 bp, Artificial Sequence; identical to SEQ ID NO: 8563
  Synthetic construct

SEQ ID NO: 12480 - DNA, 33 bp, Artificial Sequence; identical to SEQ ID NO: 8564
  Synthetic construct

SEQ ID NO: 12481 - DNA, 33 bp, Artificial Sequence; identical to SEQ ID NO: 8566
  Synthetic construct

SEQ ID NO: 12482 - DNA, 30 bp, Artificial Sequence; identical to SEQ ID NO: 8567
  Synthetic construct

SEQ ID NO: 12483 - DNA, 30 bp, Artificial Sequence; identical to SEQ ID NO: 8568
  Synthetic construct

SEQ ID NO: 12484 - DNA, 33 bp, Artificial Sequence; identical to SEQ ID NO: 1838
  Synthetic construct

SEQ ID NO: 12485 - DNA, 39 bp, Artificial Sequence; identical to SEQ ID NO: 8570
  Synthetic construct

SEQ ID NO: 12486 - DNA, 39 bp, Artificial Sequence; identical to SEQ ID NO: 8571
  Synthetic construct

SEQ ID NO: 12487 - DNA, 39 bp, Artificial Sequence; identical to SEQ ID NO: 8572
  Synthetic construct

SEQ ID NO: 12488 - DNA, 39 bp, Artificial Sequence; identical to SEQ ID NO: 8573
  Synthetic construct

SEQ ID NO: 12489 - DNA, 36 bp, Artificial Sequence; identical to SEQ ID NO: 8574
  Synthetic construct

SEQ ID NO: 12490 - DNA, 33 bp, Artificial Sequence; identical to SEQ ID NO: 8575
  Synthetic construct

SEQ ID NO: 12491 - DNA, 33 bp, Artificial Sequence; identical to SEQ ID NO: 8576
  Synthetic construct

SEQ ID NO: 12492 - DNA, 33 bp, Artificial Sequence; identical to SEQ ID NO: 8577
  Synthetic construct

SEQ ID NO: 12493 - DNA, 42 bp, Artificial Sequence; identical to SEQ ID NO: 8578
  Synthetic construct

SEQ ID NO: 12494 - DNA, 33 bp, Artificial Sequence; identical to SEQ ID NO: 8579
  Synthetic construct

SEQ ID NO: 12495 - DNA, 36 bp, Artificial Sequence; identical to SEQ ID NO: 8580
  Synthetic construct

SEQ ID NO: 12496 - DNA, 33 bp, Artificial Sequence; identical to SEQ ID NO: 8581
  Synthetic construct

SEQ ID NO: 12497 - DNA, 33 bp, Artificial Sequence; identical to SEQ ID NO: 8582
  Synthetic construct

SEQ ID NO: 12498 - DNA, 36 bp, Artificial Sequence; identical to SEQ ID NO: 8583
  Synthetic construct

SEQ ID NO: 12499 - DNA, 33 bp, Artificial Sequence; identical to SEQ ID NO: 8584
  Synthetic construct

SEQ ID NO: 12500 - DNA, 36 bp, Artificial Sequence; identical to SEQ ID NO: 8585
  Synthetic construct

SEQ ID NO: 12501 - DNA, 36 bp, Artificial Sequence; identical to SEQ ID NO: 8586
  Synthetic construct

SEQ ID NO: 12502 - DNA, 33 bp, Artificial Sequence; identical to SEQ ID NO: 8587
  Synthetic construct

SEQ ID NO: 12503 - DNA, 33 bp, Artificial Sequence; identical to SEQ ID NO: 8588
  Synthetic construct

SEQ ID NO: 12504 - DNA, 36 bp, Artificial Sequence; identical to SEQ ID NO: 8589
  Synthetic construct

SEQ ID NO: 12505 - DNA, 36 bp, Artificial Sequence; identical to SEQ ID NO: 8590
  Synthetic construct

SEQ ID NO: 12506 - DNA, 33 bp, Artificial Sequence; identical to SEQ ID NO: 8591
  Synthetic construct

SEQ ID NO: 12507 - DNA, 33 bp, Artificial Sequence; identical to SEQ ID NO: 8592
  Synthetic construct

SEQ ID NO: 12508 - DNA, 33 bp, Artificial Sequence; identical to SEQ ID NO: 8593
  Synthetic construct

SEQ ID NO: 12509 - DNA, 33 bp, Artificial Sequence; identical to SEQ ID NO: 8594
  Synthetic construct

SEQ ID NO: 12510 - DNA, 33 bp, Artificial Sequence; identical to SEQ ID NO: 8595
  Synthetic construct

SEQ ID NO: 12511 - DNA, 33 bp, Artificial Sequence; identical to SEQ ID NO: 8596
  Synthetic construct

SEQ ID NO: 12512 - DNA, 33 bp, Artificial Sequence; identical to SEQ ID NO: 8597
  Synthetic construct

SEQ ID NO: 12513 - DNA, 30 bp, Artificial Sequence; identical to SEQ ID NO: 8598
  Synthetic construct

SEQ ID NO: 12514 - DNA, 33 bp, Artificial Sequence; identical to SEQ ID NO: 8599
  Synthetic construct

SEQ ID NO: 12515 - DNA, 33 bp, Artificial Sequence; identical to SEQ ID NO: 8600
  Synthetic construct

SEQ ID NO: 12516 - DNA, 33 bp, Artificial Sequence; identical to SEQ ID NO: 8601
  Synthetic construct

SEQ ID NO: 12517 - DNA, 39 bp, Artificial Sequence; identical to SEQ ID NO: 8602
  Synthetic construct

SEQ ID NO: 12518 - DNA, 33 bp, Artificial Sequence; identical to SEQ ID NO: 8603
  Synthetic construct

SEQ ID NO: 12519 - DNA, 33 bp, Artificial Sequence; identical to SEQ ID NO: 8604
  Synthetic construct

SEQ ID NO: 12520 - DNA, 36 bp, Artificial Sequence; identical to SEQ ID NO: 8605
  Synthetic construct

SEQ ID NO: 12521 - DNA, 36 bp, Artificial Sequence; identical to SEQ ID NO: 8606
  Synthetic construct

SEQ ID NO: 12522 - DNA, 36 bp, Artificial Sequence; identical to SEQ ID NO: 8607
  Synthetic construct

SEQ ID NO: 12523 - DNA, 33 bp, Artificial Sequence; identical to SEQ ID NO: 8608
  Synthetic construct

SEQ ID NO: 12524 - DNA, 30 bp, Artificial Sequence; identical to SEQ ID NO: 8609
  Synthetic construct

SEQ ID NO: 12525 - DNA, 36 bp, Artificial Sequence; identical to SEQ ID NO: 8610
  Synthetic construct

SEQ ID NO: 12526 - DNA, 33 bp, Artificial Sequence; identical to SEQ ID NO: 8611
  Synthetic construct

SEQ ID NO: 12527 - DNA, 33 bp, Artificial Sequence; identical to SEQ ID NO: 8612
  Synthetic construct

SEQ ID NO: 12528 - DNA, 30 bp, Artificial Sequence; identical to SEQ ID NO: 8613
  Synthetic construct

SEQ ID NO: 12529 - DNA, 33 bp, Artificial Sequence; identical to SEQ ID NO: 8614
  Synthetic construct

SEQ ID NO: 12530 - DNA, 33 bp, Artificial Sequence; identical to SEQ ID NO: 8615
  Synthetic construct

SEQ ID NO: 12531 - DNA, 33 bp, Artificial Sequence; identical to SEQ ID NO: 8616
  Synthetic construct

SEQ ID NO: 12532 - DNA, 33 bp, Artificial Sequence; identical to SEQ ID NO: 8617
  Synthetic construct

SEQ ID NO: 12533 - DNA, 33 bp, Artificial Sequence; identical to SEQ ID NO: 8618
  Synthetic construct

SEQ ID NO: 12534 - DNA, 39 bp, Artificial Sequence; identical to SEQ ID NO: 8619
  Synthetic construct

SEQ ID NO: 12535 - DNA, 39 bp, Artificial Sequence; identical to SEQ ID NO: 8620
  Synthetic construct

SEQ ID NO: 12536 - DNA, 36 bp, Artificial Sequence; identical to SEQ ID NO: 8621
  Synthetic construct

SEQ ID NO: 12537 - DNA, 39 bp, Artificial Sequence; identical to SEQ ID NO: 8622
  Synthetic construct

SEQ ID NO: 12538 - DNA, 39 bp, Artificial Sequence; identical to SEQ ID NO: 8623
  Synthetic construct

SEQ ID NO: 12539 - DNA, 39 bp, Artificial Sequence; identical to SEQ ID NO: 8624
  Synthetic construct

SEQ ID NO: 12540 - DNA, 39 bp, Artificial Sequence; identical to SEQ ID NO: 8625
  Synthetic construct

SEQ ID NO: 12541 - DNA, 39 bp, Artificial Sequence; identical to SEQ ID NO: 8626
  Synthetic construct

SEQ ID NO: 12542 - DNA, 39 bp, Artificial Sequence; identical to SEQ ID NO: 8627
  Synthetic construct

SEQ ID NO: 12543 - DNA, 39 bp, Artificial Sequence; identical to SEQ ID NO: 8628
  Synthetic construct

SEQ ID NO: 12544 - DNA, 33 bp, Artificial Sequence; identical to SEQ ID NO: 8629
  Synthetic construct

SEQ ID NO: 12545 - DNA, 33 bp, Artificial Sequence; identical to SEQ ID NO: 8630
  Synthetic construct

SEQ ID NO: 12546 - DNA, 33 bp, Artificial Sequence; identical to SEQ ID NO: 8631
  Synthetic construct

SEQ ID NO: 12547 - DNA, 30 bp, Artificial Sequence; identical to SEQ ID NO: 8632
  Synthetic construct

SEQ ID NO: 12548 - DNA, 30 bp, Artificial Sequence; identical to SEQ ID NO: 8633
  Synthetic construct

SEQ ID NO: 12549 - DNA, 36 bp, Artificial Sequence; identical to SEQ ID NO: 8634
  Synthetic construct

SEQ ID NO: 12550 - DNA, 42 bp, Artificial Sequence; identical to SEQ ID NO: 8635
  Synthetic construct

SEQ ID NO: 12551 - DNA, 39 bp, Artificial Sequence; identical to SEQ ID NO: 8636
  Synthetic construct

SEQ ID NO: 12552 - DNA, 33 bp, Artificial Sequence; identical to SEQ ID NO: 8637
  Synthetic construct

SEQ ID NO: 12553 - DNA, 39 bp, Artificial Sequence; identical to SEQ ID NO: 8638
  Synthetic construct

SEQ ID NO: 12554 - DNA, 33 bp, Artificial Sequence; identical to SEQ ID NO: 8639
  Synthetic construct

SEQ ID NO: 12555 - DNA, 36 bp, Artificial Sequence; identical to SEQ ID NO: 8640
  Synthetic construct

SEQ ID NO: 12556 - DNA, 33 bp, Artificial Sequence; identical to SEQ ID NO: 8641
  Synthetic construct

SEQ ID NO: 12557 - DNA, 42 bp, Artificial Sequence; identical to SEQ ID NO: 8642
  Synthetic construct

SEQ ID NO: 12558 - DNA, 33 bp, Artificial Sequence; identical to SEQ ID NO: 8643
  Synthetic construct

SEQ ID NO: 12559 - DNA, 36 bp, Artificial Sequence; identical to SEQ ID NO: 8644
  Synthetic construct

SEQ ID NO: 12560 - DNA, 33 bp, Artificial Sequence; identical to SEQ ID NO: 8645
  Synthetic construct

SEQ ID NO: 12561 - DNA, 39 bp, Artificial Sequence; identical to SEQ ID NO: 8647
  Synthetic construct

SEQ ID NO: 12562 - DNA, 39 bp, Artificial Sequence; identical to SEQ ID NO: 8648
  Synthetic construct

SEQ ID NO: 12563 - DNA, 39 bp, Artificial Sequence; identical to SEQ ID NO: 8649
  Synthetic construct

SEQ ID NO: 12564 - DNA, 39 bp, Artificial Sequence; identical to SEQ ID NO: 8650
  Synthetic construct

SEQ ID NO: 12565 - DNA, 33 bp, Artificial Sequence; identical to SEQ ID NO: 8651
  Synthetic construct

SEQ ID NO: 12566 - DNA, 33 bp, Artificial Sequence; identical to SEQ ID NO: 8652
  Synthetic construct

SEQ ID NO: 12567 - DNA, 33 bp, Artificial Sequence; identical to SEQ ID NO: 8653
  Synthetic construct

SEQ ID NO: 12568 - DNA, 42 bp, Artificial Sequence; identical to SEQ ID NO: 8654
  Synthetic construct

SEQ ID NO: 12569 - DNA, 33 bp, Artificial Sequence; identical to SEQ ID NO: 8655
  Synthetic construct

SEQ ID NO: 12570 - DNA, 33 bp, Artificial Sequence; identical to SEQ ID NO: 8656
  Synthetic construct

SEQ ID NO: 12571 - DNA, 33 bp, Artificial Sequence; identical to SEQ ID NO: 8657
  Synthetic construct

SEQ ID NO: 12572 - DNA, 33 bp, Artificial Sequence; identical to SEQ ID NO: 8658
  Synthetic construct

SEQ ID NO: 12573 - DNA, 39 bp, Artificial Sequence; identical to SEQ ID NO: 8659
  Synthetic construct

SEQ ID NO: 12574 - DNA, 30 bp, Artificial Sequence; identical to SEQ ID NO: 8660
  Synthetic construct

SEQ ID NO: 12575 - DNA, 36 bp, Artificial Sequence; identical to SEQ ID NO: 8661
  Synthetic construct

SEQ ID NO: 12576 - DNA, 33 bp, Artificial Sequence; identical to SEQ ID NO: 8662
  Synthetic construct

SEQ ID NO: 12577 - DNA, 36 bp, Artificial Sequence; identical to SEQ ID NO: 8663
  Synthetic construct

SEQ ID NO: 12578 - DNA, 30 bp, Artificial Sequence; identical to SEQ ID NO: 8664
  Synthetic construct

SEQ ID NO: 12579 - DNA, 39 bp, Artificial Sequence; identical to SEQ ID NO: 8665
  Synthetic construct

SEQ ID NO: 12580 - DNA, 33 bp, Artificial Sequence; identical to SEQ ID NO: 8666
  Synthetic construct

SEQ ID NO: 12581 - DNA, 42 bp, Artificial Sequence; identical to SEQ ID NO: 8667
  Synthetic construct

SEQ ID NO: 12582 - DNA, 36 bp, Artificial Sequence; identical to SEQ ID NO: 8668
  Synthetic construct

SEQ ID NO: 12583 - DNA, 33 bp, Artificial Sequence; identical to SEQ ID NO: 8669
  Synthetic construct

SEQ ID NO: 12584 - DNA, 42 bp, Artificial Sequence; identical to SEQ ID NO: 8670
  Synthetic construct

SEQ ID NO: 12585 - DNA, 33 bp, Artificial Sequence; identical to SEQ ID NO: 8671
  Synthetic construct

SEQ ID NO: 12586 - DNA, 39 bp, Artificial Sequence; identical to SEQ ID NO: 8672
  Synthetic construct

SEQ ID NO: 12587 - DNA, 33 bp, Artificial Sequence; identical to SEQ ID NO: 8673
  Synthetic construct

SEQ ID NO: 12588 - DNA, 39 bp, Artificial Sequence; identical to SEQ ID NO: 8674
  Synthetic construct

SEQ ID NO: 12589 - DNA, 33 bp, Artificial Sequence; identical to SEQ ID NO: 8675
  Synthetic construct

SEQ ID NO: 12590 - DNA, 36 bp, Artificial Sequence; identical to SEQ ID NO: 8676
  Synthetic construct

SEQ ID NO: 12591 - DNA, 36 bp, Artificial Sequence; identical to SEQ ID NO: 8677
  Synthetic construct

SEQ ID NO: 12592 - DNA, 30 bp, Artificial Sequence; identical to SEQ ID NO: 8678
  Synthetic construct

SEQ ID NO: 12593 - DNA, 33 bp, Artificial Sequence; identical to SEQ ID NO: 8679
  Synthetic construct

SEQ ID NO: 12594 - DNA, 33 bp, Artificial Sequence; identical to SEQ ID NO: 8680
  Synthetic construct

SEQ ID NO: 12595 - DNA, 33 bp, Artificial Sequence; identical to SEQ ID NO: 8681
  Synthetic construct

SEQ ID NO: 12596 - DNA, 36 bp, Artificial Sequence; identical to SEQ ID NO: 8682
  Synthetic construct

SEQ ID NO: 12597 - DNA, 36 bp, Artificial Sequence; identical to SEQ ID NO: 8683
  Synthetic construct

SEQ ID NO: 12598 - DNA, 42 bp, Artificial Sequence; identical to SEQ ID NO: 8684
  Synthetic construct

SEQ ID NO: 12599 - DNA, 36 bp, Artificial Sequence; identical to SEQ ID NO: 8685
  Synthetic construct

SEQ ID NO: 12600 - DNA, 36 bp, Artificial Sequence; identical to SEQ ID NO: 8686
  Synthetic construct

SEQ ID NO: 12601 - DNA, 33 bp, Artificial Sequence; identical to SEQ ID NO: 8687
  Synthetic construct

SEQ ID NO: 12602 - DNA, 33 bp, Artificial Sequence; identical to SEQ ID NO: 8688
  Synthetic construct

SEQ ID NO: 12603 - DNA, 33 bp, Artificial Sequence; identical to SEQ ID NO: 8689
  Synthetic construct

SEQ ID NO: 12604 - DNA, 30 bp, Artificial Sequence; identical to SEQ ID NO: 8691
  Synthetic construct

SEQ ID NO: 12605 - DNA, 39 bp, Artificial Sequence; identical to SEQ ID NO: 8692
  Synthetic construct

SEQ ID NO: 12606 - DNA, 33 bp, Artificial Sequence; identical to SEQ ID NO: 8693
  Synthetic construct

SEQ ID NO: 12607 - DNA, 33 bp, Artificial Sequence; identical to SEQ ID NO: 8694
  Synthetic construct

SEQ ID NO: 12608 - DNA, 30 bp, Artificial Sequence; identical to SEQ ID NO: 8695
  Synthetic construct

SEQ ID NO: 12609 - DNA, 33 bp, Artificial Sequence; identical to SEQ ID NO: 8696
  Synthetic construct

SEQ ID NO: 12610 - DNA, 36 bp, Artificial Sequence; identical to SEQ ID NO: 8697
  Synthetic construct

SEQ ID NO: 12611 - DNA, 39 bp, Artificial Sequence; identical to SEQ ID NO: 8698
  Synthetic construct

SEQ ID NO: 12612 - DNA, 36 bp, Artificial Sequence; identical to SEQ ID NO: 8699
  Synthetic construct

SEQ ID NO: 12613 - DNA, 33 bp, Artificial Sequence; identical to SEQ ID NO: 8700
  Synthetic construct

SEQ ID NO: 12614 - DNA, 33 bp, Artificial Sequence; identical to SEQ ID NO: 8701
  Synthetic construct

SEQ ID NO: 12615 - DNA, 33 bp, Artificial Sequence; identical to SEQ ID NO: 8702
  Synthetic construct

SEQ ID NO: 12616 - DNA, 39 bp, Artificial Sequence; identical to SEQ ID NO: 8703
  Synthetic construct

SEQ ID NO: 12617 - DNA, 36 bp, Artificial Sequence; identical to SEQ ID NO: 8704
  Synthetic construct

SEQ ID NO: 12618 - DNA, 36 bp, Artificial Sequence; identical to SEQ ID NO: 8705
  Synthetic construct

SEQ ID NO: 12619 - DNA, 33 bp, Artificial Sequence; identical to SEQ ID NO: 8706
  Synthetic construct

SEQ ID NO: 12620 - DNA, 36 bp, Artificial Sequence; identical to SEQ ID NO: 8707
  Synthetic construct

SEQ ID NO: 12621 - DNA, 33 bp, Artificial Sequence; identical to SEQ ID NO: 8708
  Synthetic construct

SEQ ID NO: 12622 - DNA, 33 bp, Artificial Sequence; identical to SEQ ID NO: 8709
  Synthetic construct

SEQ ID NO: 12623 - DNA, 33 bp, Artificial Sequence; identical to SEQ ID NO: 8710
  Synthetic construct

SEQ ID NO: 12624 - DNA, 39 bp, Artificial Sequence; identical to SEQ ID NO: 8711
  Synthetic construct

SEQ ID NO: 12625 - DNA, 36 bp, Artificial Sequence; identical to SEQ ID NO: 8712
  Synthetic construct

SEQ ID NO: 12626 - DNA, 33 bp, Artificial Sequence; identical to SEQ ID NO: 8713
  Synthetic construct

SEQ ID NO: 12627 - DNA, 33 bp, Artificial Sequence; identical to SEQ ID NO: 8714
  Synthetic construct

SEQ ID NO: 12628 - DNA, 33 bp, Artificial Sequence; identical to SEQ ID NO: 8715
  Synthetic construct

SEQ ID NO: 12629 - DNA, 39 bp, Artificial Sequence; identical to SEQ ID NO: 8716
  Synthetic construct

SEQ ID NO: 12630 - DNA, 33 bp, Artificial Sequence; identical to SEQ ID NO: 8717
  Synthetic construct

SEQ ID NO: 12631 - DNA, 39 bp, Artificial Sequence; identical to SEQ ID NO: 8718
  Synthetic construct

SEQ ID NO: 12632 - DNA, 36 bp, Artificial Sequence; identical to SEQ ID NO: 8719
  Synthetic construct

SEQ ID NO: 12633 - DNA, 39 bp, Artificial Sequence; identical to SEQ ID NO: 8720
  Synthetic construct

SEQ ID NO: 12634 - DNA, 33 bp, Artificial Sequence; identical to SEQ ID NO: 8721
  Synthetic construct

SEQ ID NO: 12635 - DNA, 33 bp, Artificial Sequence; identical to SEQ ID NO: 8722
  Synthetic construct

SEQ ID NO: 12636 - DNA, 33 bp, Artificial Sequence; identical to SEQ ID NO: 8723
  Synthetic construct

SEQ ID NO: 12637 - DNA, 39 bp, Artificial Sequence; identical to SEQ ID NO: 8724
  Synthetic construct

SEQ ID NO: 12638 - DNA, 36 bp, Artificial Sequence; identical to SEQ ID NO: 8725
  Synthetic construct

SEQ ID NO: 12639 - DNA, 36 bp, Artificial Sequence; identical to SEQ ID NO: 8726
  Synthetic construct

SEQ ID NO: 12640 - DNA, 39 bp, Artificial Sequence; identical to SEQ ID NO: 8727
  Synthetic construct

SEQ ID NO: 12641 - DNA, 33 bp, Artificial Sequence; identical to SEQ ID NO: 8728
  Synthetic construct

SEQ ID NO: 12642 - DNA, 33 bp, Artificial Sequence; identical to SEQ ID NO: 8729
  Synthetic construct

SEQ ID NO: 12643 - DNA, 39 bp, Artificial Sequence; identical to SEQ ID NO: 8730
  Synthetic construct

SEQ ID NO: 12644 - DNA, 33 bp, Artificial Sequence; identical to SEQ ID NO: 8731
  Synthetic construct

SEQ ID NO: 12645 - DNA, 33 bp, Artificial Sequence; identical to SEQ ID NO: 8732
  Synthetic construct

SEQ ID NO: 12646 - DNA, 33 bp, Artificial Sequence; identical to SEQ ID NO: 8733
  Synthetic construct

SEQ ID NO: 12647 - DNA, 39 bp, Artificial Sequence; identical to SEQ ID NO: 8734
  Synthetic construct

SEQ ID NO: 12648 - DNA, 36 bp, Artificial Sequence; identical to SEQ ID NO: 8735
  Synthetic construct

SEQ ID NO: 12649 - DNA, 33 bp, Artificial Sequence; identical to SEQ ID NO: 8736
  Synthetic construct

SEQ ID NO: 12650 - DNA, 33 bp, Artificial Sequence; identical to SEQ ID NO: 8737
  Synthetic construct

SEQ ID NO: 12651 - DNA, 36 bp, Artificial Sequence; identical to SEQ ID NO: 8738
  Synthetic construct

SEQ ID NO: 12652 - DNA, 39 bp, Artificial Sequence; identical to SEQ ID NO: 8739
  Synthetic construct

SEQ ID NO: 12653 - DNA, 33 bp, Artificial Sequence; identical to SEQ ID NO: 8740
  Synthetic construct

SEQ ID NO: 12654 - DNA, 42 bp, Artificial Sequence; identical to SEQ ID NO: 8741
  Synthetic construct

SEQ ID NO: 12655 - DNA, 33 bp, Artificial Sequence; identical to SEQ ID NO: 8742
  Synthetic construct

SEQ ID NO: 12656 - DNA, 42 bp, Artificial Sequence; identical to SEQ ID NO: 8743
  Synthetic construct

SEQ ID NO: 12657 - DNA, 33 bp, Artificial Sequence; identical to SEQ ID NO: 8744
  Synthetic construct

SEQ ID NO: 12658 - DNA, 39 bp, Artificial Sequence; identical to SEQ ID NO: 8745
  Synthetic construct

SEQ ID NO: 12659 - DNA, 33 bp, Artificial Sequence; identical to SEQ ID NO: 8746
  Synthetic construct

SEQ ID NO: 12660 - DNA, 33 bp, Artificial Sequence; identical to SEQ ID NO: 8747
  Synthetic construct

SEQ ID NO: 12661 - DNA, 36 bp, Artificial Sequence; identical to SEQ ID NO: 8748
  Synthetic construct

SEQ ID NO: 12662 - DNA, 39 bp, Artificial Sequence; identical to SEQ ID NO: 8749
  Synthetic construct

SEQ ID NO: 12663 - DNA, 33 bp, Artificial Sequence; identical to SEQ ID NO: 8750
  Synthetic construct

SEQ ID NO: 12664 - DNA, 33 bp, Artificial Sequence; identical to SEQ ID NO: 8751
  Synthetic construct

SEQ ID NO: 12665 - DNA, 33 bp, Artificial Sequence; identical to SEQ ID NO: 8752
  Synthetic construct

SEQ ID NO: 12666 - DNA, 21 bp, Artificial Sequence
  Synthetic construct
tgtcaacaccttaggacgttc

SEQ ID NO: 12667 - DNA, 36 bp, Artificial Sequence; identical to SEQ ID NO: 8754
  Synthetic construct

SEQ ID NO: 12668 - DNA, 33 bp, Artificial Sequence; identical to SEQ ID NO: 8755
  Synthetic construct

SEQ ID NO: 12669 - DNA, 33 bp, Artificial Sequence; identical to SEQ ID NO: 8756
  Synthetic construct

SEQ ID NO: 12670 - DNA, 33 bp, Artificial Sequence; identical to SEQ ID NO: 8757
  Synthetic construct

SEQ ID NO: 12671 - DNA, 39 bp, Artificial Sequence; identical to SEQ ID NO: 8758
  Synthetic construct

SEQ ID NO: 12672 - DNA, 36 bp, Artificial Sequence; identical to SEQ ID NO: 8759
  Synthetic construct

SEQ ID NO: 12673 - DNA, 39 bp, Artificial Sequence; identical to SEQ ID NO: 8760
  Synthetic construct

SEQ ID NO: 12674 - DNA, 39 bp, Artificial Sequence; identical to SEQ ID NO: 8761
  Synthetic construct

SEQ ID NO: 12675 - DNA, 30 bp, Artificial Sequence; identical to SEQ ID NO: 8762
  Synthetic construct

SEQ ID NO: 12676 - DNA, 33 bp, Artificial Sequence; identical to SEQ ID NO: 8763
  Synthetic construct

SEQ ID NO: 12677 - DNA, 39 bp, Artificial Sequence; identical to SEQ ID NO: 8764
  Synthetic construct

SEQ ID NO: 12678 - DNA, 33 bp, Artificial Sequence; identical to SEQ ID NO: 8765
  Synthetic construct

SEQ ID NO: 12679 - DNA, 36 bp, Artificial Sequence; identical to SEQ ID NO: 8766
  Synthetic construct

SEQ ID NO: 12680 - DNA, 42 bp, Artificial Sequence; identical to SEQ ID NO: 8767
  Synthetic construct

SEQ ID NO: 12681 - DNA, 30 bp, Artificial Sequence; identical to SEQ ID NO: 8768
  Synthetic construct

SEQ ID NO: 12682 - DNA, 42 bp, Artificial Sequence; identical to SEQ ID NO: 8769
  Synthetic construct

SEQ ID NO: 12683 - DNA, 33 bp, Artificial Sequence; identical to SEQ ID NO: 8690
  Synthetic construct

SEQ ID NO: 12684 - DNA, 39 bp, Artificial Sequence; identical to SEQ ID NO: 8770
  Synthetic construct

SEQ ID NO: 12685 - DNA, 33 bp, Artificial Sequence; identical to SEQ ID NO: 8771
  Synthetic construct

SEQ ID NO: 12686 - DNA, 42 bp, Artificial Sequence; identical to SEQ ID NO: 8772
  Synthetic construct

SEQ ID NO: 12687 - DNA, 33 bp, Artificial Sequence; identical to SEQ ID NO: 8773
  Synthetic construct

SEQ ID NO: 12688 - DNA, 30 bp, Artificial Sequence; identical to SEQ ID NO: 8774
  Synthetic construct

SEQ ID NO: 12689 - DNA, 30 bp, Artificial Sequence; identical to SEQ ID NO: 8775
  Synthetic construct

SEQ ID NO: 12690 - DNA, 33 bp, Artificial Sequence; identical to SEQ ID NO: 8776
  Synthetic construct

SEQ ID NO: 12691 - DNA, 39 bp, Artificial Sequence; identical to SEQ ID NO: 8777
  Synthetic construct

SEQ ID NO: 12692 - DNA, 39 bp, Artificial Sequence; identical to SEQ ID NO: 8778
  Synthetic construct

SEQ ID NO: 12693 - DNA, 45 bp, Artificial Sequence; identical to SEQ ID NO: 8779
  Synthetic construct

SEQ ID NO: 12694 - DNA, 33 bp, Artificial Sequence; identical to SEQ ID NO: 8780
  Synthetic construct

SEQ ID NO: 12695 - DNA, 36 bp, Artificial Sequence; identical to SEQ ID NO: 8781
  Synthetic construct

SEQ ID NO: 12696 - DNA, 27 bp, Artificial Sequence
  Synthetic construct
tgccaacagtataatagttacactttt

SEQ ID NO: 12697 - DNA, 36 bp, Artificial Sequence; identical to SEQ ID NO: 8783
  Synthetic construct

SEQ ID NO: 12698 - DNA, 33 bp, Artificial Sequence; identical to SEQ ID NO: 8784
  Synthetic construct

SEQ ID NO: 12699 - DNA, 33 bp, Artificial Sequence; identical to SEQ ID NO: 8785
  Synthetic construct

SEQ ID NO: 12700 - DNA, 33 bp, Artificial Sequence; identical to SEQ ID NO: 8786
  Synthetic construct

SEQ ID NO: 12701 - DNA, 33 bp, Artificial Sequence; identical to SEQ ID NO: 8787
  Synthetic construct

SEQ ID NO: 12702 - DNA, 33 bp, Artificial Sequence; identical to SEQ ID NO: 8788
  Synthetic construct

SEQ ID NO: 12703 - DNA, 33 bp, Artificial Sequence; identical to SEQ ID NO: 8789
  Synthetic construct

SEQ ID NO: 12704 - DNA, 33 bp, Artificial Sequence; identical to SEQ ID NO: 8790
  Synthetic construct

SEQ ID NO: 12705 - DNA, 36 bp, Artificial Sequence; identical to SEQ ID NO: 8791
  Synthetic construct

SEQ ID NO: 12706 - DNA, 36 bp, Artificial Sequence; identical to SEQ ID NO: 8792
  Synthetic construct

SEQ ID NO: 12707 - DNA, 39 bp, Artificial Sequence; identical to SEQ ID NO: 8793
  Synthetic construct

SEQ ID NO: 12708 - DNA, 30 bp, Artificial Sequence; identical to SEQ ID NO: 8794
  Synthetic construct

SEQ ID NO: 12709 - DNA, 30 bp, Artificial Sequence; identical to SEQ ID NO: 8795
  Synthetic construct

SEQ ID NO: 12710 - DNA, 33 bp, Artificial Sequence; identical to SEQ ID NO: 8796
  Synthetic construct

SEQ ID NO: 12711 - DNA, 33 bp, Artificial Sequence; identical to SEQ ID NO: 8797
  Synthetic construct

SEQ ID NO: 12712 - DNA, 33 bp, Artificial Sequence; identical to SEQ ID NO: 8798
  Synthetic construct

SEQ ID NO: 12713 - DNA, 39 bp, Artificial Sequence; identical to SEQ ID NO: 8799
  Synthetic construct

SEQ ID NO: 12714 - DNA, 36 bp, Artificial Sequence; identical to SEQ ID NO: 8800
  Synthetic construct

SEQ ID NO: 12715 - DNA, 30 bp, Artificial Sequence; identical to SEQ ID NO: 8801
  Synthetic construct

SEQ ID NO: 12716 - DNA, 33 bp, Artificial Sequence; identical to SEQ ID NO: 8802
  Synthetic construct

SEQ ID NO: 12717 - DNA, 36 bp, Artificial Sequence; identical to SEQ ID NO: 8803
  Synthetic construct

SEQ ID NO: 12718 - DNA, 36 bp, Artificial Sequence; identical to SEQ ID NO: 8804
  Synthetic construct

SEQ ID NO: 12719 - DNA, 36 bp, Artificial Sequence; identical to SEQ ID NO: 8805
  Synthetic construct

SEQ ID NO: 12720 - DNA, 36 bp, Artificial Sequence; identical to SEQ ID NO: 8806
  Synthetic construct

SEQ ID NO: 12721 - DNA, 36 bp, Artificial Sequence; identical to SEQ ID NO: 8807
  Synthetic construct

SEQ ID NO: 12722 - DNA, 33 bp, Artificial Sequence; identical to SEQ ID NO: 8808
  Synthetic construct

SEQ ID NO: 12723 - DNA, 39 bp, Artificial Sequence; identical to SEQ ID NO: 8809
  Synthetic construct

SEQ ID NO: 12724 - DNA, 36 bp, Artificial Sequence; identical to SEQ ID NO: 8810
  Synthetic construct

SEQ ID NO: 12725 - DNA, 33 bp, Artificial Sequence; identical to SEQ ID NO: 8811
  Synthetic construct

SEQ ID NO: 12726 - DNA, 36 bp, Artificial Sequence; identical to SEQ ID NO: 8812
  Synthetic construct

SEQ ID NO: 12727 - DNA, 33 bp, Artificial Sequence; identical to SEQ ID NO: 8813
  Synthetic construct

SEQ ID NO: 12728 - DNA, 33 bp, Artificial Sequence; identical to SEQ ID NO: 8814
  Synthetic construct

SEQ ID NO: 12729 - DNA, 33 bp, Artificial Sequence; identical to SEQ ID NO: 8815
  Synthetic construct

SEQ ID NO: 12730 - DNA, 39 bp, Artificial Sequence; identical to SEQ ID NO: 8816
  Synthetic construct

SEQ ID NO: 12731 - DNA, 33 bp, Artificial Sequence; identical to SEQ ID NO: 8817
  Synthetic construct

SEQ ID NO: 12732 - DNA, 33 bp, Artificial Sequence; identical to SEQ ID NO: 8818
  Synthetic construct

SEQ ID NO: 12733 - DNA, 30 bp, Artificial Sequence; identical to SEQ ID NO: 8819
  Synthetic construct

SEQ ID NO: 12734 - DNA, 36 bp, Artificial Sequence; identical to SEQ ID NO: 8820
  Synthetic construct

SEQ ID NO: 12735 - DNA, 33 bp, Artificial Sequence; identical to SEQ ID NO: 8821
  Synthetic construct

SEQ ID NO: 12736 - DNA, 33 bp, Artificial Sequence; identical to SEQ ID NO: 8822
  Synthetic construct

SEQ ID NO: 12737 - DNA, 36 bp, Artificial Sequence; identical to SEQ ID NO: 8823
  Synthetic construct

SEQ ID NO: 12738 - DNA, 33 bp, Artificial Sequence; identical to SEQ ID NO: 8824
  Synthetic construct

SEQ ID NO: 12739 - DNA, 33 bp, Artificial Sequence; identical to SEQ ID NO: 8825
  Synthetic construct

SEQ ID NO: 12740 - DNA, 36 bp, Artificial Sequence; identical to SEQ ID NO: 8827
  Synthetic construct

SEQ ID NO: 12741 - DNA, 33 bp, Artificial Sequence; identical to SEQ ID NO: 8828
  Synthetic construct

SEQ ID NO: 12742 - DNA, 33 bp, Artificial Sequence; identical to SEQ ID NO: 8829
  Synthetic construct

SEQ ID NO: 12743 - DNA, 39 bp, Artificial Sequence; identical to SEQ ID NO: 8830
  Synthetic construct

SEQ ID NO: 12744 - DNA, 36 bp, Artificial Sequence; identical to SEQ ID NO: 8831
  Synthetic construct

SEQ ID NO: 12745 - DNA, 33 bp, Artificial Sequence; identical to SEQ ID NO: 8832
  Synthetic construct

SEQ ID NO: 12746 - DNA, 36 bp, Artificial Sequence; identical to SEQ ID NO: 8833
  Synthetic construct

SEQ ID NO: 12747 - DNA, 33 bp, Artificial Sequence; identical to SEQ ID NO: 8834
  Synthetic construct

SEQ ID NO: 12748 - DNA, 33 bp, Artificial Sequence; identical to SEQ ID NO: 8836
  Synthetic construct

SEQ ID NO: 12749 - DNA, 36 bp, Artificial Sequence; identical to SEQ ID NO: 8837
  Synthetic construct

SEQ ID NO: 12750 - DNA, 36 bp, Artificial Sequence; identical to SEQ ID NO: 8838
  Synthetic construct

SEQ ID NO: 12751 - DNA, 36 bp, Artificial Sequence; identical to SEQ ID NO: 8839
  Synthetic construct

SEQ ID NO: 12752 - DNA, 36 bp, Artificial Sequence; identical to SEQ ID NO: 8840
  Synthetic construct

SEQ ID NO: 12753 - DNA, 33 bp, Artificial Sequence; identical to SEQ ID NO: 8841
  Synthetic construct

SEQ ID NO: 12754 - DNA, 36 bp, Artificial Sequence; identical to SEQ ID NO: 8842
  Synthetic construct

SEQ ID NO: 12755 - DNA, 33 bp, Artificial Sequence; identical to SEQ ID NO: 8843
  Synthetic construct

SEQ ID NO: 12756 - DNA, 33 bp, Artificial Sequence; identical to SEQ ID NO: 8844
  Synthetic construct

SEQ ID NO: 12757 - DNA, 33 bp, Artificial Sequence; identical to SEQ ID NO: 8845
  Synthetic construct

SEQ ID NO: 12758 - DNA, 33 bp, Artificial Sequence; identical to SEQ ID NO: 8846
  Synthetic construct

SEQ ID NO: 12759 - DNA, 33 bp, Artificial Sequence; identical to SEQ ID NO: 1837
  Synthetic construct

SEQ ID NO: 12760 - DNA, 33 bp, Artificial Sequence; identical to SEQ ID NO: 8848
  Synthetic construct

SEQ ID NO: 12761 - DNA, 33 bp, Artificial Sequence; identical to SEQ ID NO: 8849
  Synthetic construct

SEQ ID NO: 12762 - DNA, 39 bp, Artificial Sequence; identical to SEQ ID NO: 8850
  Synthetic construct

SEQ ID NO: 12763 - DNA, 36 bp, Artificial Sequence; identical to SEQ ID NO: 8851
  Synthetic construct

SEQ ID NO: 12764 - DNA, 33 bp, Artificial Sequence; identical to SEQ ID NO: 8852
  Synthetic construct

SEQ ID NO: 12765 - DNA, 36 bp, Artificial Sequence; identical to SEQ ID NO: 8853
  Synthetic construct

SEQ ID NO: 12766 - DNA, 33 bp, Artificial Sequence; identical to SEQ ID NO: 8854
  Synthetic construct

SEQ ID NO: 12767 - DNA, 33 bp, Artificial Sequence; identical to SEQ ID NO: 8855
  Synthetic construct

SEQ ID NO: 12768 - DNA, 33 bp, Artificial Sequence; identical to SEQ ID NO: 8856
  Synthetic construct

SEQ ID NO: 12769 - DNA, 33 bp, Artificial Sequence; identical to SEQ ID NO: 8857
  Synthetic construct

SEQ ID NO: 12770 - DNA, 33 bp, Artificial Sequence; identical to SEQ ID NO: 8858
  Synthetic construct

SEQ ID NO: 12771 - DNA, 33 bp, Artificial Sequence; identical to SEQ ID NO: 8859
  Synthetic construct

SEQ ID NO: 12772 - DNA, 33 bp, Artificial Sequence; identical to SEQ ID NO: 8860
  Synthetic construct

SEQ ID NO: 12773 - DNA, 33 bp, Artificial Sequence; identical to SEQ ID NO: 8861
  Synthetic construct

SEQ ID NO: 12774 - DNA, 33 bp, Artificial Sequence; identical to SEQ ID NO: 8862
  Synthetic construct

SEQ ID NO: 12775 - DNA, 39 bp, Artificial Sequence; identical to SEQ ID NO: 8863
  Synthetic construct

SEQ ID NO: 12776 - DNA, 36 bp, Artificial Sequence; identical to SEQ ID NO: 8864
  Synthetic construct

SEQ ID NO: 12777 - DNA, 24 bp, Artificial Sequence
  Synthetic construct
tgccaataccccccgaggacgttc

SEQ ID NO: 12778 - DNA, 36 bp, Artificial Sequence; identical to SEQ ID NO: 8866
  Synthetic construct

SEQ ID NO: 12779 - DNA, 33 bp, Artificial Sequence; identical to SEQ ID NO: 8867
  Synthetic construct

SEQ ID NO: 12780 - DNA, 42 bp, Artificial Sequence; identical to SEQ ID NO: 8868
  Synthetic construct

SEQ ID NO: 12781 - DNA, 33 bp, Artificial Sequence; identical to SEQ ID NO: 8869
  Synthetic construct

SEQ ID NO: 12782 - DNA, 33 bp, Artificial Sequence; identical to SEQ ID NO: 8870
  Synthetic construct

SEQ ID NO: 12783 - DNA, 39 bp, Artificial Sequence; identical to SEQ ID NO: 8872
  Synthetic construct

SEQ ID NO: 12784 - DNA, 36 bp, Artificial Sequence; identical to SEQ ID NO: 8873
  Synthetic construct

SEQ ID NO: 12785 - DNA, 33 bp, Artificial Sequence; identical to SEQ ID NO: 8874
  Synthetic construct

SEQ ID NO: 12786 - DNA, 42 bp, Artificial Sequence; identical to SEQ ID NO: 8875
  Synthetic construct

SEQ ID NO: 12787 - DNA, 33 bp, Artificial Sequence; identical to SEQ ID NO: 8876
  Synthetic construct

SEQ ID NO: 12788 - DNA, 36 bp, Artificial Sequence; identical to SEQ ID NO: 8877
  Synthetic construct

SEQ ID NO: 12789 - DNA, 36 bp, Artificial Sequence; identical to SEQ ID NO: 8878
  Synthetic construct

SEQ ID NO: 12790 - DNA, 39 bp, Artificial Sequence; identical to SEQ ID NO: 8879
  Synthetic construct

SEQ ID NO: 12791 - DNA, 39 bp, Artificial Sequence; identical to SEQ ID NO: 8880
  Synthetic construct

SEQ ID NO: 12792 - DNA, 33 bp, Artificial Sequence; identical to SEQ ID NO: 8881
  Synthetic construct

SEQ ID NO: 12793 - DNA, 36 bp, Artificial Sequence; identical to SEQ ID NO: 8882
  Synthetic construct

SEQ ID NO: 12794 - DNA, 30 bp, Artificial Sequence; identical to SEQ ID NO: 8883
  Synthetic construct

SEQ ID NO: 12795 - DNA, 36 bp, Artificial Sequence; identical to SEQ ID NO: 8884
  Synthetic construct

SEQ ID NO: 12796 - DNA, 36 bp, Artificial Sequence; identical to SEQ ID NO: 8885
  Synthetic construct

SEQ ID NO: 12797 - DNA, 33 bp, Artificial Sequence; identical to SEQ ID NO: 8886
  Synthetic construct

SEQ ID NO: 12798 - DNA, 36 bp, Artificial Sequence; identical to SEQ ID NO: 8887
  Synthetic construct

SEQ ID NO: 12799 - DNA, 39 bp, Artificial Sequence; identical to SEQ ID NO: 8888
  Synthetic construct

SEQ ID NO: 12800 - DNA, 30 bp, Artificial Sequence; identical to SEQ ID NO: 8889
  Synthetic construct

SEQ ID NO: 12801 - DNA, 33 bp, Artificial Sequence; identical to SEQ ID NO: 8890
  Synthetic construct

SEQ ID NO: 12802 - DNA, 36 bp, Artificial Sequence; identical to SEQ ID NO: 8892
  Synthetic construct

SEQ ID NO: 12803 - DNA, 36 bp, Artificial Sequence; identical to SEQ ID NO: 8893
  Synthetic construct

SEQ ID NO: 12804 - DNA, 33 bp, Artificial Sequence; identical to SEQ ID NO: 8894
  Synthetic construct

SEQ ID NO: 12805 - DNA, 33 bp, Artificial Sequence; identical to SEQ ID NO: 8895
  Synthetic construct

SEQ ID NO: 12806 - DNA, 36 bp, Artificial Sequence; identical to SEQ ID NO: 8896
  Synthetic construct

SEQ ID NO: 12807 - DNA, 36 bp, Artificial Sequence; identical to SEQ ID NO: 8897
  Synthetic construct

SEQ ID NO: 12808 - DNA, 36 bp, Artificial Sequence; identical to SEQ ID NO: 8898
  Synthetic construct

SEQ ID NO: 12809 - DNA, 33 bp, Artificial Sequence; identical to SEQ ID NO: 8899
  Synthetic construct

SEQ ID NO: 12810 - DNA, 33 bp, Artificial Sequence; identical to SEQ ID NO: 8900
  Synthetic construct

SEQ ID NO: 12811 - DNA, 36 bp, Artificial Sequence; identical to SEQ ID NO: 8901
  Synthetic construct

SEQ ID NO: 12812 - DNA, 39 bp, Artificial Sequence; identical to SEQ ID NO: 8902
  Synthetic construct

SEQ ID NO: 12813 - DNA, 36 bp, Artificial Sequence; identical to SEQ ID NO: 8903
  Synthetic construct

SEQ ID NO: 12814 - DNA, 30 bp, Artificial Sequence; identical to SEQ ID NO: 8904
  Synthetic construct

SEQ ID NO: 12815 - DNA, 39 bp, Artificial Sequence; identical to SEQ ID NO: 8905
  Synthetic construct

SEQ ID NO: 12816 - DNA, 36 bp, Artificial Sequence; identical to SEQ ID NO: 8906
  Synthetic construct

SEQ ID NO: 12817 - DNA, 33 bp, Artificial Sequence; identical to SEQ ID NO: 8907
  Synthetic construct

SEQ ID NO: 12818 - DNA, 39 bp, Artificial Sequence; identical to SEQ ID NO: 8908
  Synthetic construct

SEQ ID NO: 12819 - DNA, 24 bp, Artificial Sequence
  Synthetic construct
tgtcagcagcgtgacttcactttc

SEQ ID NO: 12820 - DNA, 33 bp, Artificial Sequence; identical to SEQ ID NO: 8910
  Synthetic construct

SEQ ID NO: 12821 - DNA, 33 bp, Artificial Sequence; identical to SEQ ID NO: 8911
  Synthetic construct

SEQ ID NO: 12822 - DNA, 36 bp, Artificial Sequence; identical to SEQ ID NO: 8912
  Synthetic construct

SEQ ID NO: 12823 - DNA, 33 bp, Artificial Sequence; identical to SEQ ID NO: 8913
  Synthetic construct

SEQ ID NO: 12824 - DNA, 39 bp, Artificial Sequence; identical to SEQ ID NO: 8914
  Synthetic construct

SEQ ID NO: 12825 - DNA, 33 bp, Artificial Sequence; identical to SEQ ID NO: 8915
  Synthetic construct

SEQ ID NO: 12826 - DNA, 33 bp, Artificial Sequence; identical to SEQ ID NO: 8916
  Synthetic construct

SEQ ID NO: 12827 - DNA, 36 bp, Artificial Sequence; identical to SEQ ID NO: 8917
  Synthetic construct

SEQ ID NO: 12828 - DNA, 33 bp, Artificial Sequence; identical to SEQ ID NO: 8918
  Synthetic construct

SEQ ID NO: 12829 - DNA, 36 bp, Artificial Sequence; identical to SEQ ID NO: 8919
  Synthetic construct

SEQ ID NO: 12830 - DNA, 33 bp, Artificial Sequence; identical to SEQ ID NO: 8920
  Synthetic construct

SEQ ID NO: 12831 - DNA, 39 bp, Artificial Sequence; identical to SEQ ID NO: 8921
  Synthetic construct

SEQ ID NO: 12832 - DNA, 33 bp, Artificial Sequence; identical to SEQ ID NO: 8922
  Synthetic construct

SEQ ID NO: 12833 - DNA, 42 bp, Artificial Sequence; identical to SEQ ID NO: 8923
  Synthetic construct

SEQ ID NO: 12834 - DNA, 33 bp, Artificial Sequence; identical to SEQ ID NO: 8924
  Synthetic construct

SEQ ID NO: 12835 - DNA, 36 bp, Artificial Sequence; identical to SEQ ID NO: 8925
  Synthetic construct

SEQ ID NO: 12836 - DNA, 33 bp, Artificial Sequence; identical to SEQ ID NO: 8926
  Synthetic construct

SEQ ID NO: 12837 - DNA, 33 bp, Artificial Sequence; identical to SEQ ID NO: 8927
  Synthetic construct

SEQ ID NO: 12838 - DNA, 33 bp, Artificial Sequence; identical to SEQ ID NO: 8928
  Synthetic construct

SEQ ID NO: 12839 - DNA, 33 bp, Artificial Sequence; identical to SEQ ID NO: 8929
  Synthetic construct

SEQ ID NO: 12840 - DNA, 30 bp, Artificial Sequence; identical to SEQ ID NO: 8930
  Synthetic construct

SEQ ID NO: 12841 - DNA, 39 bp, Artificial Sequence; identical to SEQ ID NO: 8931
  Synthetic construct

SEQ ID NO: 12842 - DNA, 33 bp, Artificial Sequence; identical to SEQ ID NO: 8932
  Synthetic construct

SEQ ID NO: 12843 - DNA, 33 bp, Artificial Sequence; identical to SEQ ID NO: 8933
  Synthetic construct

SEQ ID NO: 12844 - DNA, 33 bp, Artificial Sequence; identical to SEQ ID NO: 8934
  Synthetic construct

SEQ ID NO: 12845 - DNA, 36 bp, Artificial Sequence; identical to SEQ ID NO: 8935
  Synthetic construct

SEQ ID NO: 12846 - DNA, 36 bp, Artificial Sequence; identical to SEQ ID NO: 8936
  Synthetic construct

SEQ ID NO: 12847 - DNA, 33 bp, Artificial Sequence; identical to SEQ ID NO: 8937
  Synthetic construct

SEQ ID NO: 12848 - DNA, 36 bp, Artificial Sequence; identical to SEQ ID NO: 8938
  Synthetic construct

SEQ ID NO: 12849 - DNA, 33 bp, Artificial Sequence; identical to SEQ ID NO: 8939
  Synthetic construct

SEQ ID NO: 12850 - DNA, 30 bp, Artificial Sequence; identical to SEQ ID NO: 8940
  Synthetic construct

SEQ ID NO: 12851 - DNA, 33 bp, Artificial Sequence; identical to SEQ ID NO: 8941
  Synthetic construct

SEQ ID NO: 12852 - DNA, 33 bp, Artificial Sequence; identical to SEQ ID NO: 8942
  Synthetic construct

SEQ ID NO: 12853 - DNA, 30 bp, Artificial Sequence; identical to SEQ ID NO: 8943
  Synthetic construct

SEQ ID NO: 12854 - DNA, 39 bp, Artificial Sequence; identical to SEQ ID NO: 8944
  Synthetic construct

SEQ ID NO: 12855 - DNA, 36 bp, Artificial Sequence; identical to SEQ ID NO: 8945
  Synthetic construct

SEQ ID NO: 12856 - DNA, 33 bp, Artificial Sequence; identical to SEQ ID NO: 8946
  Synthetic construct

SEQ ID NO: 12857 - DNA, 33 bp, Artificial Sequence; identical to SEQ ID NO: 8947
  Synthetic construct

SEQ ID NO: 12858 - DNA, 33 bp, Artificial Sequence; identical to SEQ ID NO: 8948
  Synthetic construct

SEQ ID NO: 12859 - DNA, 33 bp, Artificial Sequence; identical to SEQ ID NO: 8949
  Synthetic construct

SEQ ID NO: 12860 - DNA, 36 bp, Artificial Sequence; identical to SEQ ID NO: 8950
  Synthetic construct

SEQ ID NO: 12861 - DNA, 30 bp, Artificial Sequence; identical to SEQ ID NO: 8951
  Synthetic construct

SEQ ID NO: 12862 - DNA, 39 bp, Artificial Sequence; identical to SEQ ID NO: 8952
  Synthetic construct

SEQ ID NO: 12863 - DNA, 33 bp, Artificial Sequence; identical to SEQ ID NO: 8953
  Synthetic construct

SEQ ID NO: 12864 - DNA, 36 bp, Artificial Sequence; identical to SEQ ID NO: 8954
  Synthetic construct

SEQ ID NO: 12865 - DNA, 36 bp, Artificial Sequence; identical to SEQ ID NO: 8955
  Synthetic construct

SEQ ID NO: 12866 - DNA, 33 bp, Artificial Sequence; identical to SEQ ID NO: 8956
  Synthetic construct

SEQ ID NO: 12867 - DNA, 33 bp, Artificial Sequence; identical to SEQ ID NO: 8957
  Synthetic construct

SEQ ID NO: 12868 - DNA, 39 bp, Artificial Sequence; identical to SEQ ID NO: 8958
  Synthetic construct

SEQ ID NO: 12869 - DNA, 39 bp, Artificial Sequence; identical to SEQ ID NO: 8959
  Synthetic construct

SEQ ID NO: 12870 - DNA, 39 bp, Artificial Sequence; identical to SEQ ID NO: 8960
  Synthetic construct

SEQ ID NO: 12871 - DNA, 33 bp, Artificial Sequence; identical to SEQ ID NO: 8961
  Synthetic construct

SEQ ID NO: 12872 - DNA, 33 bp, Artificial Sequence; identical to SEQ ID NO: 8962
  Synthetic construct

SEQ ID NO: 12873 - DNA, 39 bp, Artificial Sequence; identical to SEQ ID NO: 8963
  Synthetic construct

SEQ ID NO: 12874 - DNA, 33 bp, Artificial Sequence; identical to SEQ ID NO: 8964
  Synthetic construct

SEQ ID NO: 12875 - DNA, 36 bp, Artificial Sequence; identical to SEQ ID NO: 8965
  Synthetic construct

SEQ ID NO: 12876 - DNA, 33 bp, Artificial Sequence; identical to SEQ ID NO: 8966
  Synthetic construct

SEQ ID NO: 12877 - DNA, 33 bp, Artificial Sequence; identical to SEQ ID NO: 8967
  Synthetic construct

SEQ ID NO: 12878 - DNA, 39 bp, Artificial Sequence; identical to SEQ ID NO: 8968
  Synthetic construct

SEQ ID NO: 12879 - DNA, 36 bp, Artificial Sequence; identical to SEQ ID NO: 8969
  Synthetic construct

SEQ ID NO: 12880 - DNA, 39 bp, Artificial Sequence; identical to SEQ ID NO: 8970
  Synthetic construct

SEQ ID NO: 12881 - DNA, 39 bp, Artificial Sequence; identical to SEQ ID NO: 8971
  Synthetic construct

SEQ ID NO: 12882 - DNA, 30 bp, Artificial Sequence; identical to SEQ ID NO: 8972
  Synthetic construct

SEQ ID NO: 12883 - DNA, 33 bp, Artificial Sequence; identical to SEQ ID NO: 8973
  Synthetic construct

SEQ ID NO: 12884 - DNA, 39 bp, Artificial Sequence; identical to SEQ ID NO: 8974
  Synthetic construct

SEQ ID NO: 12885 - DNA, 30 bp, Artificial Sequence; identical to SEQ ID NO: 1836
  Synthetic construct

SEQ ID NO: 12886 - DNA, 33 bp, Artificial Sequence; identical to SEQ ID NO: 8976
  Synthetic construct

SEQ ID NO: 12887 - DNA, 33 bp, Artificial Sequence; identical to SEQ ID NO: 8977
  Synthetic construct

SEQ ID NO: 12888 - DNA, 33 bp, Artificial Sequence; identical to SEQ ID NO: 8978
  Synthetic construct

SEQ ID NO: 12889 - DNA, 36 bp, Artificial Sequence; identical to SEQ ID NO: 8979
  Synthetic construct

SEQ ID NO: 12890 - DNA, 39 bp, Artificial Sequence; identical to SEQ ID NO: 8980
  Synthetic construct

SEQ ID NO: 12891 - DNA, 30 bp, Artificial Sequence; identical to SEQ ID NO: 8981
  Synthetic construct

SEQ ID NO: 12892 - DNA, 33 bp, Artificial Sequence; identical to SEQ ID NO: 8982
  Synthetic construct

SEQ ID NO: 12893 - DNA, 33 bp, Artificial Sequence; identical to SEQ ID NO: 8983
  Synthetic construct

SEQ ID NO: 12894 - DNA, 39 bp, Artificial Sequence; identical to SEQ ID NO: 8984
  Synthetic construct

SEQ ID NO: 12895 - DNA, 39 bp, Artificial Sequence; identical to SEQ ID NO: 8985
  Synthetic construct

SEQ ID NO: 12896 - DNA, 33 bp, Artificial Sequence; identical to SEQ ID NO: 8986
  Synthetic construct

SEQ ID NO: 12897 - DNA, 39 bp, Artificial Sequence; identical to SEQ ID NO: 8987
  Synthetic construct

SEQ ID NO: 12898 - DNA, 36 bp, Artificial Sequence; identical to SEQ ID NO: 8988
  Synthetic construct

SEQ ID NO: 12899 - DNA, 33 bp, Artificial Sequence; identical to SEQ ID NO: 8989
  Synthetic construct

SEQ ID NO: 12900 - DNA, 33 bp, Artificial Sequence; identical to SEQ ID NO: 8990
  Synthetic construct

SEQ ID NO: 12901 - DNA, 36 bp, Artificial Sequence; identical to SEQ ID NO: 1839
  Synthetic construct

SEQ ID NO: 12902 - DNA, 33 bp, Artificial Sequence; identical to SEQ ID NO: 8992
  Synthetic construct

SEQ ID NO: 12903 - DNA, 33 bp, Artificial Sequence; identical to SEQ ID NO: 8993
  Synthetic construct

SEQ ID NO: 12904 - DNA, 30 bp, Artificial Sequence; identical to SEQ ID NO: 8994
  Synthetic construct

SEQ ID NO: 12905 - DNA, 33 bp, Artificial Sequence; identical to SEQ ID NO: 8995
  Synthetic construct

SEQ ID NO: 12906 - DNA, 39 bp, Artificial Sequence; identical to SEQ ID NO: 8996
  Synthetic construct

SEQ ID NO: 12907 - DNA, 30 bp, Artificial Sequence; identical to SEQ ID NO: 8997
  Synthetic construct

SEQ ID NO: 12908 - DNA, 36 bp, Artificial Sequence; identical to SEQ ID NO: 8998
  Synthetic construct

SEQ ID NO: 12909 - DNA, 33 bp, Artificial Sequence; identical to SEQ ID NO: 8999
  Synthetic construct

SEQ ID NO: 12910 - DNA, 33 bp, Artificial Sequence; identical to SEQ ID NO: 9000
  Synthetic construct

SEQ ID NO: 12911 - DNA, 42 bp, Artificial Sequence; identical to SEQ ID NO: 9001
  Synthetic construct

SEQ ID NO: 12912 - DNA, 39 bp, Artificial Sequence; identical to SEQ ID NO: 9002
  Synthetic construct

SEQ ID NO: 12913 - DNA, 33 bp, Artificial Sequence; identical to SEQ ID NO: 9003
  Synthetic construct

SEQ ID NO: 12914 - DNA, 33 bp, Artificial Sequence; identical to SEQ ID NO: 9004
  Synthetic construct

SEQ ID NO: 12915 - DNA, 33 bp, Artificial Sequence; identical to SEQ ID NO: 1835
  Synthetic construct

SEQ ID NO: 12916 - DNA, 36 bp, Artificial Sequence; identical to SEQ ID NO: 9006
  Synthetic construct

SEQ ID NO: 12917 - DNA, 33 bp, Artificial Sequence; identical to SEQ ID NO: 9007
  Synthetic construct

SEQ ID NO: 12918 - DNA, 33 bp, Artificial Sequence; identical to SEQ ID NO: 9008
  Synthetic construct

SEQ ID NO: 12919 - DNA, 33 bp, Artificial Sequence; identical to SEQ ID NO: 9009
  Synthetic construct

SEQ ID NO: 12920 - DNA, 36 bp, Artificial Sequence; identical to SEQ ID NO: 9010
  Synthetic construct

SEQ ID NO: 12921 - DNA, 39 bp, Artificial Sequence; identical to SEQ ID NO: 9011
  Synthetic construct

SEQ ID NO: 12922 - DNA, 39 bp, Artificial Sequence; identical to SEQ ID NO: 9012
  Synthetic construct

SEQ ID NO: 12923 - DNA, 39 bp, Artificial Sequence; identical to SEQ ID NO: 9013
  Synthetic construct

SEQ ID NO: 12924 - DNA, 33 bp, Artificial Sequence; identical to SEQ ID NO: 9014
  Synthetic construct

SEQ ID NO: 12925 - DNA, 39 bp, Artificial Sequence; identical to SEQ ID NO: 9015
  Synthetic construct

SEQ ID NO: 12926 - DNA, 39 bp, Artificial Sequence; identical to SEQ ID NO: 9016
  Synthetic construct

SEQ ID NO: 12927 - DNA, 39 bp, Artificial Sequence; identical to SEQ ID NO: 9017
  Synthetic construct

SEQ ID NO: 12928 - DNA, 33 bp, Artificial Sequence; identical to SEQ ID NO: 9018
  Synthetic construct

SEQ ID NO: 12929 - DNA, 33 bp, Artificial Sequence; identical to SEQ ID NO: 9019
  Synthetic construct

SEQ ID NO: 12930 - DNA, 36 bp, Artificial Sequence; identical to SEQ ID NO: 9020
  Synthetic construct

SEQ ID NO: 12931 - DNA, 33 bp, Artificial Sequence; identical to SEQ ID NO: 9021
  Synthetic construct

SEQ ID NO: 12932 - DNA, 33 bp, Artificial Sequence; identical to SEQ ID NO: 9022
  Synthetic construct

SEQ ID NO: 12933 - DNA, 30 bp, Artificial Sequence; identical to SEQ ID NO: 9023
  Synthetic construct

SEQ ID NO: 12934 - DNA, 33 bp, Artificial Sequence; identical to SEQ ID NO: 9024
  Synthetic construct

SEQ ID NO: 12935 - DNA, 39 bp, Artificial Sequence; identical to SEQ ID NO: 9025
  Synthetic construct

SEQ ID NO: 12936 - DNA, 39 bp, Artificial Sequence; identical to SEQ ID NO: 9026
  Synthetic construct

SEQ ID NO: 12937 - DNA, 33 bp, Artificial Sequence; identical to SEQ ID NO: 9027
  Synthetic construct

SEQ ID NO: 12938 - DNA, 39 bp, Artificial Sequence; identical to SEQ ID NO: 9028
  Synthetic construct

SEQ ID NO: 12939 - DNA, 33 bp, Artificial Sequence; identical to SEQ ID NO: 9029
  Synthetic construct

SEQ ID NO: 12940 - DNA, 39 bp, Artificial Sequence; identical to SEQ ID NO: 9030
  Synthetic construct

SEQ ID NO: 12941 - DNA, 39 bp, Artificial Sequence; identical to SEQ ID NO: 9031
  Synthetic construct

SEQ ID NO: 12942 - DNA, 33 bp, Artificial Sequence; identical to SEQ ID NO: 9032
  Synthetic construct

SEQ ID NO: 12943 - DNA, 36 bp, Artificial Sequence; identical to SEQ ID NO: 9033
  Synthetic construct

SEQ ID NO: 12944 - DNA, 36 bp, Artificial Sequence; identical to SEQ ID NO: 9034
  Synthetic construct

SEQ ID NO: 12945 - DNA, 33 bp, Artificial Sequence; identical to SEQ ID NO: 9035
  Synthetic construct

SEQ ID NO: 12946 - DNA, 39 bp, Artificial Sequence; identical to SEQ ID NO: 9036
  Synthetic construct

SEQ ID NO: 12947 - DNA, 33 bp, Artificial Sequence; identical to SEQ ID NO: 9037
  Synthetic construct

SEQ ID NO: 12948 - DNA, 33 bp, Artificial Sequence; identical to SEQ ID NO: 9038
  Synthetic construct

SEQ ID NO: 12949 - DNA, 39 bp, Artificial Sequence; identical to SEQ ID NO: 9039
  Synthetic construct

SEQ ID NO: 12950 - DNA, 33 bp, Artificial Sequence; identical to SEQ ID NO: 9040
  Synthetic construct

SEQ ID NO: 12951 - DNA, 33 bp, Artificial Sequence; identical to SEQ ID NO: 9041
  Synthetic construct

SEQ ID NO: 12952 - DNA, 33 bp, Artificial Sequence; identical to SEQ ID NO: 9042
  Synthetic construct

SEQ ID NO: 12953 - DNA, 33 bp, Artificial Sequence; identical to SEQ ID NO: 9043
  Synthetic construct

SEQ ID NO: 12954 - DNA, 42 bp, Artificial Sequence; identical to SEQ ID NO: 9044
  Synthetic construct

SEQ ID NO: 12955 - DNA, 33 bp, Artificial Sequence; identical to SEQ ID NO: 9045
  Synthetic construct

SEQ ID NO: 12956 - DNA, 36 bp, Artificial Sequence; identical to SEQ ID NO: 9046
  Synthetic construct

SEQ ID NO: 12957 - DNA, 33 bp, Artificial Sequence; identical to SEQ ID NO: 9047
  Synthetic construct

SEQ ID NO: 12958 - DNA, 33 bp, Artificial Sequence; identical to SEQ ID NO: 9048
  Synthetic construct

SEQ ID NO: 12959 - DNA, 33 bp, Artificial Sequence; identical to SEQ ID NO: 9049
  Synthetic construct

SEQ ID NO: 12960 - DNA, 39 bp, Artificial Sequence; identical to SEQ ID NO: 9050
  Synthetic construct

SEQ ID NO: 12961 - DNA, 39 bp, Artificial Sequence; identical to SEQ ID NO: 9051
  Synthetic construct

SEQ ID NO: 12962 - DNA, 36 bp, Artificial Sequence; identical to SEQ ID NO: 9052
  Synthetic construct

SEQ ID NO: 12963 - DNA, 33 bp, Artificial Sequence; identical to SEQ ID NO: 9053
  Synthetic construct

SEQ ID NO: 12964 - DNA, 33 bp, Artificial Sequence; identical to SEQ ID NO: 9054
  Synthetic construct

SEQ ID NO: 12965 - DNA, 33 bp, Artificial Sequence; identical to SEQ ID NO: 9055
  Synthetic construct

SEQ ID NO: 12966 - DNA, 33 bp, Artificial Sequence; identical to SEQ ID NO: 9056
  Synthetic construct

SEQ ID NO: 12967 - DNA, 21 bp, Artificial Sequence
  Synthetic construct
tgtcaacagagtggcactttc

SEQ ID NO: 12968 - DNA, 30 bp, Artificial Sequence; identical to SEQ ID NO: 9058
  Synthetic construct

SEQ ID NO: 12969 - DNA, 39 bp, Artificial Sequence; identical to SEQ ID NO: 9059
  Synthetic construct

SEQ ID NO: 12970 - DNA, 39 bp, Artificial Sequence; identical to SEQ ID NO: 9060
  Synthetic construct

SEQ ID NO: 12971 - DNA, 33 bp, Artificial Sequence; identical to SEQ ID NO: 9061
  Synthetic construct

SEQ ID NO: 12972 - DNA, 30 bp, Artificial Sequence; identical to SEQ ID NO: 9062
  Synthetic construct

SEQ ID NO: 12973 - DNA, 33 bp, Artificial Sequence; identical to SEQ ID NO: 9063
  Synthetic construct

SEQ ID NO: 12974 - DNA, 33 bp, Artificial Sequence; identical to SEQ ID NO: 9064
  Synthetic construct

SEQ ID NO: 12975 - DNA, 39 bp, Artificial Sequence; identical to SEQ ID NO: 9065
  Synthetic construct

SEQ ID NO: 12976 - DNA, 39 bp, Artificial Sequence; identical to SEQ ID NO: 9066
  Synthetic construct

SEQ ID NO: 12977 - DNA, 39 bp, Artificial Sequence; identical to SEQ ID NO: 9067
  Synthetic construct

SEQ ID NO: 12978 - DNA, 33 bp, Artificial Sequence; identical to SEQ ID NO: 9068
  Synthetic construct

SEQ ID NO: 12979 - DNA, 39 bp, Artificial Sequence; identical to SEQ ID NO: 9069
  Synthetic construct

SEQ ID NO: 12980 - DNA, 39 bp, Artificial Sequence; identical to SEQ ID NO: 9070
  Synthetic construct

SEQ ID NO: 12981 - DNA, 39 bp, Artificial Sequence; identical to SEQ ID NO: 9071
  Synthetic construct

SEQ ID NO: 12982 - DNA, 33 bp, Artificial Sequence; identical to SEQ ID NO: 9072
  Synthetic construct

SEQ ID NO: 12983 - DNA, 33 bp, Artificial Sequence; identical to SEQ ID NO: 9073
  Synthetic construct

SEQ ID NO: 12984 - DNA, 39 bp, Artificial Sequence; identical to SEQ ID NO: 9074
  Synthetic construct

SEQ ID NO: 12985 - DNA, 39 bp, Artificial Sequence; identical to SEQ ID NO: 9075
  Synthetic construct

SEQ ID NO: 12986 - DNA, 33 bp, Artificial Sequence; identical to SEQ ID NO: 9076
  Synthetic construct

SEQ ID NO: 12987 - DNA, 33 bp, Artificial Sequence; identical to SEQ ID NO: 9077
  Synthetic construct

SEQ ID NO: 12988 - DNA, 33 bp, Artificial Sequence; identical to SEQ ID NO: 9078
  Synthetic construct

SEQ ID NO: 12989 - DNA, 33 bp, Artificial Sequence; identical to SEQ ID NO: 9079
  Synthetic construct

SEQ ID NO: 12990 - DNA, 36 bp, Artificial Sequence; identical to SEQ ID NO: 9080
  Synthetic construct

SEQ ID NO: 12991 - DNA, 33 bp, Artificial Sequence; identical to SEQ ID NO: 9081
  Synthetic construct

SEQ ID NO: 12992 - DNA, 33 bp, Artificial Sequence; identical to SEQ ID NO: 9082
  Synthetic construct

SEQ ID NO: 12993 - DNA, 39 bp, Artificial Sequence; identical to SEQ ID NO: 9083
  Synthetic construct

SEQ ID NO: 12994 - DNA, 33 bp, Artificial Sequence; identical to SEQ ID NO: 8565
  Synthetic construct

SEQ ID NO: 12995 - DNA, 39 bp, Artificial Sequence; identical to SEQ ID NO: 9084
  Synthetic construct

SEQ ID NO: 12996 - DNA, 39 bp, Artificial Sequence; identical to SEQ ID NO: 9085
  Synthetic construct

SEQ ID NO: 12997 - DNA, 36 bp, Artificial Sequence; identical to SEQ ID NO: 9086
  Synthetic construct

SEQ ID NO: 12998 - DNA, 33 bp, Artificial Sequence; identical to SEQ ID NO: 9087
  Synthetic construct

SEQ ID NO: 12999 - DNA, 30 bp, Artificial Sequence; identical to SEQ ID NO: 9088
  Synthetic construct

SEQ ID NO: 13000 - DNA, 30 bp, Artificial Sequence; identical to SEQ ID NO: 9089
  Synthetic construct

SEQ ID NO: 13001 - DNA, 33 bp, Artificial Sequence; identical to SEQ ID NO: 9090
  Synthetic construct

SEQ ID NO: 13002 - DNA, 36 bp, Artificial Sequence; identical to SEQ ID NO: 9091
  Synthetic construct

SEQ ID NO: 13003 - DNA, 33 bp, Artificial Sequence; identical to SEQ ID NO: 9092
  Synthetic construct

SEQ ID NO: 13004 - DNA, 33 bp, Artificial Sequence; identical to SEQ ID NO: 9093
  Synthetic construct

SEQ ID NO: 13005 - DNA, 33 bp, Artificial Sequence; identical to SEQ ID NO: 9094
  Synthetic construct

SEQ ID NO: 13006 - DNA, 33 bp, Artificial Sequence; identical to SEQ ID NO: 9095
  Synthetic construct

SEQ ID NO: 13007 - DNA, 33 bp, Artificial Sequence; identical to SEQ ID NO: 9096
  Synthetic construct

SEQ ID NO: 13008 - DNA, 33 bp, Artificial Sequence; identical to SEQ ID NO: 9097
  Synthetic construct

SEQ ID NO: 13009 - DNA, 39 bp, Artificial Sequence; identical to SEQ ID NO: 9098
  Synthetic construct

SEQ ID NO: 13010 - DNA, 33 bp, Artificial Sequence; identical to SEQ ID NO: 9099
  Synthetic construct

SEQ ID NO: 13011 - DNA, 33 bp, Artificial Sequence; identical to SEQ ID NO: 9100
  Synthetic construct

SEQ ID NO: 13012 - DNA, 33 bp, Artificial Sequence; identical to SEQ ID NO: 9101
  Synthetic construct

SEQ ID NO: 13013 - DNA, 33 bp, Artificial Sequence; identical to SEQ ID NO: 9102
  Synthetic construct

SEQ ID NO: 13014 - DNA, 33 bp, Artificial Sequence; identical to SEQ ID NO: 9103
  Synthetic construct

SEQ ID NO: 13015 - DNA, 33 bp, Artificial Sequence; identical to SEQ ID NO: 9104
  Synthetic construct

SEQ ID NO: 13016 - DNA, 33 bp, Artificial Sequence; identical to SEQ ID NO: 9105
  Synthetic construct

SEQ ID NO: 13017 - DNA, 33 bp, Artificial Sequence; identical to SEQ ID NO: 9106
  Synthetic construct

SEQ ID NO: 13018 - DNA, 33 bp, Artificial Sequence; identical to SEQ ID NO: 9107
  Synthetic construct

SEQ ID NO: 13019 - DNA, 36 bp, Artificial Sequence; identical to SEQ ID NO: 9108
  Synthetic construct

SEQ ID NO: 13020 - DNA, 39 bp, Artificial Sequence; identical to SEQ ID NO: 9109
  Synthetic construct

SEQ ID NO: 13021 - DNA, 33 bp, Artificial Sequence; identical to SEQ ID NO: 9110
  Synthetic construct

SEQ ID NO: 13022 - DNA, 33 bp, Artificial Sequence; identical to SEQ ID NO: 9111
  Synthetic construct

SEQ ID NO: 13023 - DNA, 33 bp, Artificial Sequence; identical to SEQ ID NO: 9112
  Synthetic construct

SEQ ID NO: 13024 - DNA, 33 bp, Artificial Sequence; identical to SEQ ID NO: 9113
  Synthetic construct

SEQ ID NO: 13025 - DNA, 33 bp, Artificial Sequence; identical to SEQ ID NO: 9114
  Synthetic construct

SEQ ID NO: 13026 - DNA, 36 bp, Artificial Sequence; identical to SEQ ID NO: 9115
  Synthetic construct

SEQ ID NO: 13027 - DNA, 33 bp, Artificial Sequence; identical to SEQ ID NO: 9116
  Synthetic construct

SEQ ID NO: 13028 - DNA, 33 bp, Artificial Sequence; identical to SEQ ID NO: 9117
  Synthetic construct

SEQ ID NO: 13029 - DNA, 33 bp, Artificial Sequence; identical to SEQ ID NO: 9118
  Synthetic construct

SEQ ID NO: 13030 - DNA, 36 bp, Artificial Sequence; identical to SEQ ID NO: 9119
  Synthetic construct

SEQ ID NO: 13031 - DNA, 39 bp, Artificial Sequence; identical to SEQ ID NO: 9120
  Synthetic construct

SEQ ID NO: 13032 - DNA, 33 bp, Artificial Sequence; identical to SEQ ID NO: 9121
  Synthetic construct

SEQ ID NO: 13033 - DNA, 33 bp, Artificial Sequence; identical to SEQ ID NO: 9122
  Synthetic construct

SEQ ID NO: 13034 - DNA, 36 bp, Artificial Sequence; identical to SEQ ID NO: 9123
  Synthetic construct

SEQ ID NO: 13035 - DNA, 33 bp, Artificial Sequence; identical to SEQ ID NO: 9124
  Synthetic construct

SEQ ID NO: 13036 - DNA, 36 bp, Artificial Sequence; identical to SEQ ID NO: 9125
  Synthetic construct

SEQ ID NO: 13037 - DNA, 36 bp, Artificial Sequence; identical to SEQ ID NO: 9126
  Synthetic construct

SEQ ID NO: 13038 - DNA, 39 bp, Artificial Sequence; identical to SEQ ID NO: 9127
  Synthetic construct

SEQ ID NO: 13039 - DNA, 45 bp, Artificial Sequence; identical to SEQ ID NO: 9128
  Synthetic construct

SEQ ID NO: 13040 - DNA, 33 bp, Artificial Sequence; identical to SEQ ID NO: 9129
  Synthetic construct

SEQ ID NO: 13041 - DNA, 33 bp, Artificial Sequence; identical to SEQ ID NO: 9130
  Synthetic construct

SEQ ID NO: 13042 - DNA, 39 bp, Artificial Sequence; identical to SEQ ID NO: 9131
  Synthetic construct

SEQ ID NO: 13043 - DNA, 39 bp, Artificial Sequence; identical to SEQ ID NO: 9132
  Synthetic construct

SEQ ID NO: 13044 - DNA, 33 bp, Artificial Sequence; identical to SEQ ID NO: 9133
  Synthetic construct

SEQ ID NO: 13045 - DNA, 30 bp, Artificial Sequence; identical to SEQ ID NO: 9134
  Synthetic construct

SEQ ID NO: 13046 - DNA, 33 bp, Artificial Sequence; identical to SEQ ID NO: 9135
  Synthetic construct

SEQ ID NO: 13047 - DNA, 33 bp, Artificial Sequence; identical to SEQ ID NO: 9136
  Synthetic construct

SEQ ID NO: 13048 - DNA, 39 bp, Artificial Sequence; identical to SEQ ID NO: 9137
  Synthetic construct

SEQ ID NO: 13049 - DNA, 33 bp, Artificial Sequence; identical to SEQ ID NO: 9138
  Synthetic construct

SEQ ID NO: 13050 - DNA, 33 bp, Artificial Sequence; identical to SEQ ID NO: 9139
  Synthetic construct

SEQ ID NO: 13051 - DNA, 33 bp, Artificial Sequence; identical to SEQ ID NO: 9140
  Synthetic construct

SEQ ID NO: 13052 - DNA, 30 bp, Artificial Sequence; identical to SEQ ID NO: 9141
  Synthetic construct

SEQ ID NO: 13053 - DNA, 39 bp, Artificial Sequence; identical to SEQ ID NO: 9142
  Synthetic construct

SEQ ID NO: 13054 - DNA, 33 bp, Artificial Sequence; identical to SEQ ID NO: 9143
  Synthetic construct

SEQ ID NO: 13055 - DNA, 33 bp, Artificial Sequence; identical to SEQ ID NO: 9144
  Synthetic construct

SEQ ID NO: 13056 - DNA, 33 bp, Artificial Sequence; identical to SEQ ID NO: 9145
  Synthetic construct

SEQ ID NO: 13057 - DNA, 39 bp, Artificial Sequence; identical to SEQ ID NO: 9146
  Synthetic construct

SEQ ID NO: 13058 - DNA, 33 bp, Artificial Sequence; identical to SEQ ID NO: 9147
  Synthetic construct

SEQ ID NO: 13059 - DNA, 36 bp, Artificial Sequence; identical to SEQ ID NO: 9148
  Synthetic construct

SEQ ID NO: 13060 - DNA, 33 bp, Artificial Sequence; identical to SEQ ID NO: 9149
  Synthetic construct

SEQ ID NO: 13061 - DNA, 42 bp, Artificial Sequence; identical to SEQ ID NO: 9150
  Synthetic construct

SEQ ID NO: 13062 - DNA, 36 bp, Artificial Sequence; identical to SEQ ID NO: 9151
  Synthetic construct

SEQ ID NO: 13063 - DNA, 33 bp, Artificial Sequence; identical to SEQ ID NO: 9152
  Synthetic construct

SEQ ID NO: 13064 - DNA, 33 bp, Artificial Sequence; identical to SEQ ID NO: 9153
  Synthetic construct

SEQ ID NO: 13065 - DNA, 33 bp, Artificial Sequence; identical to SEQ ID NO: 9154
  Synthetic construct

SEQ ID NO: 13066 - DNA, 39 bp, Artificial Sequence; identical to SEQ ID NO: 9155
  Synthetic construct

SEQ ID NO: 13067 - DNA, 39 bp, Artificial Sequence; identical to SEQ ID NO: 9156
  Synthetic construct

SEQ ID NO: 13068 - DNA, 33 bp, Artificial Sequence; identical to SEQ ID NO: 9157
  Synthetic construct

SEQ ID NO: 13069 - DNA, 39 bp, Artificial Sequence; identical to SEQ ID NO: 8646
  Synthetic construct

SEQ ID NO: 13070 - DNA, 39 bp, Artificial Sequence; identical to SEQ ID NO: 9158
  Synthetic construct

SEQ ID NO: 13071 - DNA, 39 bp, Artificial Sequence; identical to SEQ ID NO: 9159
  Synthetic construct

SEQ ID NO: 13072 - DNA, 39 bp, Artificial Sequence; identical to SEQ ID NO: 9160
  Synthetic construct

SEQ ID NO: 13073 - DNA, 33 bp, Artificial Sequence; identical to SEQ ID NO: 9161
  Synthetic construct

SEQ ID NO: 13074 - DNA, 33 bp, Artificial Sequence; identical to SEQ ID NO: 9162
  Synthetic construct

SEQ ID NO: 13075 - DNA, 33 bp, Artificial Sequence; identical to SEQ ID NO: 9163
  Synthetic construct

SEQ ID NO: 13076 - DNA, 39 bp, Artificial Sequence; identical to SEQ ID NO: 9164
  Synthetic construct

SEQ ID NO: 13077 - DNA, 39 bp, Artificial Sequence; identical to SEQ ID NO: 9165
  Synthetic construct

SEQ ID NO: 13078 - DNA, 36 bp, Artificial Sequence; identical to SEQ ID NO: 9166
  Synthetic construct

SEQ ID NO: 13079 - DNA, 39 bp, Artificial Sequence; identical to SEQ ID NO: 9167
  Synthetic construct

SEQ ID NO: 13080 - DNA, 33 bp, Artificial Sequence; identical to SEQ ID NO: 9168
  Synthetic construct

SEQ ID NO: 13081 - DNA, 36 bp, Artificial Sequence; identical to SEQ ID NO: 9169
  Synthetic construct

SEQ ID NO: 13082 - DNA, 30 bp, Artificial Sequence; identical to SEQ ID NO: 9170
  Synthetic construct

SEQ ID NO: 13083 - DNA, 36 bp, Artificial Sequence; identical to SEQ ID NO: 9171
  Synthetic construct

SEQ ID NO: 13084 - DNA, 30 bp, Artificial Sequence; identical to SEQ ID NO: 9172
  Synthetic construct

SEQ ID NO: 13085 - DNA, 30 bp, Artificial Sequence; identical to SEQ ID NO: 9173
  Synthetic construct

SEQ ID NO: 13086 - DNA, 33 bp, Artificial Sequence; identical to SEQ ID NO: 9174
  Synthetic construct

SEQ ID NO: 13087 - DNA, 33 bp, Artificial Sequence; identical to SEQ ID NO: 9175
  Synthetic construct

SEQ ID NO: 13088 - DNA, 36 bp, Artificial Sequence; identical to SEQ ID NO: 9176
  Synthetic construct

SEQ ID NO: 13089 - DNA, 39 bp, Artificial Sequence; identical to SEQ ID NO: 9177
  Synthetic construct

SEQ ID NO: 13090 - DNA, 33 bp, Artificial Sequence; identical to SEQ ID NO: 9178
  Synthetic construct

SEQ ID NO: 13091 - DNA, 39 bp, Artificial Sequence; identical to SEQ ID NO: 9179
  Synthetic construct

SEQ ID NO: 13092 - DNA, 39 bp, Artificial Sequence; identical to SEQ ID NO: 1840
  Synthetic construct

SEQ ID NO: 13093 - DNA, 39 bp, Artificial Sequence; identical to SEQ ID NO: 9181
  Synthetic construct

SEQ ID NO: 13094 - DNA, 36 bp, Artificial Sequence; identical to SEQ ID NO: 9182
  Synthetic construct

SEQ ID NO: 13095 - DNA, 33 bp, Artificial Sequence; identical to SEQ ID NO: 9183
  Synthetic construct

SEQ ID NO: 13096 - DNA, 33 bp, Artificial Sequence; identical to SEQ ID NO: 9184
  Synthetic construct

SEQ ID NO: 13097 - DNA, 30 bp, Artificial Sequence; identical to SEQ ID NO: 9185
  Synthetic construct

SEQ ID NO: 13098 - DNA, 42 bp, Artificial Sequence; identical to SEQ ID NO: 9186
  Synthetic construct

SEQ ID NO: 13099 - DNA, 39 bp, Artificial Sequence; identical to SEQ ID NO: 9187
  Synthetic construct

SEQ ID NO: 13100 - DNA, 36 bp, Artificial Sequence; identical to SEQ ID NO: 9188
  Synthetic construct

SEQ ID NO: 13101 - DNA, 30 bp, Artificial Sequence; identical to SEQ ID NO: 9189
  Synthetic construct

SEQ ID NO: 13102 - protein, 8 aa, Artificial Sequence
  Synthetic construct
GFTFDTAW

SEQ ID NO: 13103 - protein, 8 aa, Artificial Sequence
  Synthetic construct
GFSISFYA

SEQ ID NO: 13104 - protein, 8 aa, Artificial Sequence
  Synthetic construct
GFTFSGYS

SEQ ID NO: 13105 - protein, 8 aa, Artificial Sequence
  Synthetic construct
GYPFSDYD

SEQ ID NO: 13106 - protein, 8 aa, Artificial Sequence
  Synthetic construct
GYSFTPFY

SEQ ID NO: 13107 - protein, 8 aa, Artificial Sequence
  Synthetic construct
GLTFSTSE

SEQ ID NO: 13108 - protein, 10 aa, Artificial Sequence
  Synthetic construct
IQSKNDGGTI

SEQ ID NO: 13109 - protein, 8 aa, Artificial Sequence
  Synthetic construct
FSGSGDRL

SEQ ID NO: 13110 - protein, 8 aa, Artificial Sequence
  Synthetic construct
ISTGSTKI

SEQ ID NO: 13111 - protein, 8 aa, Artificial Sequence
  Synthetic construct
MNPASGNT

SEQ ID NO: 13112 - protein, 8 aa, Artificial Sequence
  Synthetic construct
INPSGGGT

SEQ ID NO: 13113 - protein, 7 aa, Artificial Sequence
  Synthetic construct
IGRGSSI

SEQ ID NO: 13114 - DNA, 379 bp, Artificial Sequence; identical to SEQ ID NO: 1763
  Synthetic construct

SEQ ID NO: 13115 - DNA, 358 bp, Artificial Sequence; identical to SEQ ID NO: 1764
  Synthetic construct

SEQ ID NO: 13116 - DNA, 364 bp, Artificial Sequence; identical to SEQ ID NO: 1765
  Synthetic construct

SEQ ID NO: 13117 - DNA, 370 bp, Artificial Sequence; identical to SEQ ID NO: 1766
  Synthetic construct

SEQ ID NO: 13118 - DNA, 370 bp, Artificial Sequence; identical to SEQ ID NO: 1767
  Synthetic construct

SEQ ID NO: 13119 - DNA, 379 bp, Artificial Sequence; identical to SEQ ID NO: 1768
  Synthetic construct

SEQ ID NO: 13120 - protein, 11 aa, Artificial Sequence
  Synthetic construct
QSLLHNNGYNF

SEQ ID NO: 13121 - protein, 6 aa, Artificial Sequence
  Synthetic construct
QYIGSF

SEQ ID NO: 13122 - protein, 6 aa, Artificial Sequence
  Synthetic construct
QSIGSY

SEQ ID NO: 13123 - protein, 12 aa, Artificial Sequence
  Synthetic construct
QSVLYTPNNKNY

SEQ ID NO: 13124 - protein, 9 aa, Artificial Sequence
  Synthetic construct
STYVDAFTY

SEQ ID NO: 13125 - protein, 6 aa, Artificial Sequence
  Synthetic construct
YFEVKS

SEQ ID NO: 13126 - protein, 3 aa, Artificial Sequence
  Synthetic construct
LAS

SEQ ID NO: 13127 - protein, 3 aa, Artificial Sequence
  Synthetic construct
AAS

SEQ ID NO: 13128 - protein, 3 aa, Artificial Sequence
  Synthetic construct
YAS

SEQ ID NO: 13129 - protein, 3 aa, Artificial Sequence
  Synthetic construct
WAS

SEQ ID NO: 13130 - protein, 3 aa, Artificial Sequence
  Synthetic construct
DVN

SEQ ID NO: 13131 - protein, 3 aa, Artificial Sequence
  Synthetic construct
DDT

SEQ ID NO: 13132 - DNA, 337 bp, Artificial Sequence; identical to SEQ ID NO: 1829
  Synthetic construct

SEQ ID NO: 13133 - DNA, 319 bp, Artificial Sequence; identical to SEQ ID NO: 1830
  Synthetic construct

SEQ ID NO: 13134 - DNA, 322 bp, Artificial Sequence; identical to SEQ ID NO: 1831
  Synthetic construct

SEQ ID NO: 13135 - DNA, 340 bp, Artificial Sequence; identical to SEQ ID NO: 1832
  Synthetic construct

SEQ ID NO: 13136 - DNA, 331 bp, Artificial Sequence; identical to SEQ ID NO: 1833
  Synthetic construct

SEQ ID NO: 13137 - DNA, 325 bp, Artificial Sequence; identical to SEQ ID NO: 1834
  Synthetic construct

SEQ ID NO: 13138 - protein, 15 aa, Artificial Sequence
  Synthetic construct
  misc_feature (9)..(9): Xaa can be any naturally occurring amino acid
CAREQRDYXSGFDYW

SEQ ID NO: 13139 - protein, 21 aa, Artificial Sequence
  Synthetic construct
CARLRRDGSYHHGAPFYFDNW

SEQ ID NO: 13140 - protein, 16 aa, Artificial Sequence
  Synthetic construct
CARGGYQDSAGYADYW

SEQ ID NO: 13141 - protein, 21 aa, Artificial Sequence
  Synthetic construct
CARGGRDLVRGLVMTDFFDEW

SEQ ID NO: 13142 - protein, 17 aa, Artificial Sequence
  Synthetic construct
CARLRWSSSWYYRFDYW

SEQ ID NO: 13143 - protein, 25 aa, Artificial Sequence
  Synthetic construct
CTTAFSMKYCSSTNCPRSDWYFDLW

SEQ ID NO: 13144 - protein, 123 aa, Artificial Sequence
  Synthetic construct
EVQLVESGPGLVKPSETLSLTCTVSGGSISYSSYYWGWIRQPPGKGLEWIGSIYYSGSTYSNPSLKSRVTISVDTSKNQFSLKLSSVTAADTAVYYCARLRWSSSWYYRFDYWGQGTLVTVSS

SEQ ID NO: 13145 - protein, 114 aa, Artificial Sequence
  Synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARYFDYWGQGTLVTVSS

SEQ ID NO: 13146 - protein, 121 aa, Artificial Sequence
  Synthetic construct
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 13147 - protein, 115 aa, Artificial Sequence
  Synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARAEYFQHWGQGTLVTVSS

SEQ ID NO: 13148 - protein, 17 aa, Artificial Sequence
  Synthetic construct
CARVAPPGVVNNKWFDI

SEQ ID NO: 13149 - protein, 17 aa, Artificial Sequence
  Synthetic construct
CARVPPPGVVNNKWLDL

SEQ ID NO: 13150 - protein, 17 aa, Artificial Sequence
  Synthetic construct
CARVSPPGVVNKKWFDI

SEQ ID NO: 13151 - protein, 11 aa, Artificial Sequence
  Synthetic construct
CCLYAGSYSWV

SEQ ID NO: 13152 - protein, 11 aa, Artificial Sequence
  Synthetic construct
CCSYAGSYWAV

SEQ ID NO: 13153 - protein, 21 aa, Artificial Sequence
  Synthetic construct
CTRSEKRNTMARKIKGRWFDS

SEQ ID NO: 13154 - protein, 21 aa, Artificial Sequence
  Synthetic construct
CARSEKRVTMTRKIKGRWFGP

SEQ ID NO: 13155 - protein, 21 aa, Artificial Sequence
  Synthetic construct
CARSEKRITMARKIKGRWFDP

What is claimed is:

1. A recombinant antibody for binding both Human Immunodeficiency virus (HIV) and Hepatitis C virus (HCV), said antibody comprising a light chain variable region (VL) that comprises a light chain complementarity determining region (CDRL) 1, CDRL2, and CDRL3 and a heavy chain variable region (VH) that comprises a heavy chain complementarity determining region (CDRH) 1, CDRH2, and CDRH3, wherein:

(i) CDRH1 is SEQ ID NO: 13107, CDRH2 is SEQ ID NO: 13113, CDRH3 is SEQ ID NO: 110 or 1822, CDRL1 is SEQ ID NO: 13125, CDRL2 is SEQ ID NO: 13131, and CDRL3 is SEQ ID NO: 101 or 1888;

(ii) CDRH1 is SEQ ID NO: 13106, CDRH2 is SEQ ID NO: 13112, CDRH3 is SEQ ID NO: 104 or 1821, CDRL1 is SEQ ID NO: 13124, CDRL2 is SEQ ID NO: 13130, and CDRL3 is SEQ ID NO: 88 or 1887;

(iii) CDRH1 is SEQ ID NO: 13102, CDRH2 is SEQ ID NO: 13108, CDRH3 is SEQ ID NO: 1817, CDRL1 is SEQ ID NO: 13120, CDRL2 is SEQ ID NO: 13126, and CDRL3 is SEQ ID NO: 13 or 1883;

(iv) CDRH1 is SEQ ID NO: 13103, CDRH2 is SEQ ID NO: 13109, CDRH3 is SEQ ID NO: 1818, CDRL1 is SEQ ID NO: 13121, CDRL2 is SEQ ID NO: 13127, and CDRL3 is SEQ ID NO: 25 or 1884;

(v) CDRH1 is SEQ ID NO: 13104, CDRH2 is SEQ ID NO: 13110, CDRH3 is SEQ ID NO: 1819, CDRL1 is SEQ ID NO: 13122, CDRL2 is SEQ ID NO: 13128, and CDRL3 is SEQ ID NO: 39 or 1885; or (vi) CDRH1 is SEQ ID NO: 13105, CDRH2 is SEQ ID NO: 13111, CDRH3 is SEQ ID NO: 1820, CDRL1 is SEQ ID NO: 13123, CDRL2 is SEQ ID NO: 13129, and CDRL3 is SEQ ID NO: 49 or 1886.

2. The recombinant antibody of claim 1, wherein the VL comprises an amino acid sequence selected from SEQ ID NOs: 119, 227, 242, 351, 1399, 1406, and 1899-1904.

3. The recombinant antibody of claim 1, wherein the VH comprises an amino acid sequence selected from the group consisting of SEQ ID NOs: 1694-1756.

4. The recombinant antibody of claim 1, wherein the VH comprises an amino acid sequence selected from the group consisting of SEQ ID NOs: 1895-1898, 1694, and 1718.

5. A method of treating a HIV/HCV co-infection comprising administering to a subject a therapeutically effective amount of the recombinant antibody of claim 1.

6. A method of treating an HIV infection comprising administering to a subject a therapeutically effective amount of the recombinant antibody of claim 1.

7. A method of treating an HCV infection comprising administering to a subject a therapeutically effective amount of the recombinant antibody of claim 1.

8. The recombinant antibody of claim 1, wherein CDRH1 is SEQ ID NO: 13107, CDRH2 is SEQ ID NO: 13113, CDRH3 is SEQ ID NO: 110 or 1822, CDRL1 is SEQ ID NO: 13125, CDRL2 is SEQ ID NO: 13131, and CDRL3 is SEQ ID NO: 101 or 1888.

9. The recombinant antibody of claim 8, wherein the VH comprises SEQ ID NO: 1718, or an amino acid sequence at least 60% identical thereto, and wherein the VL comprises SEQ ID NO: 1406, or an amino acid sequence at least 60% identical thereto.

10. The recombinant antibody of claim 1, wherein CDRH1 is SEQ ID NO: 13106, CDRH2 is SEQ ID NO: 13112, CDRH3 is SEQ ID NO: 104 or 1821, CDRL1 is SEQ ID NO: 13124, CDRL2 is SEQ ID NO: 13130, and CDRL3 is SEQ ID NO: 88 or 1887.

11. The recombinant antibody of claim 10, wherein the VH comprises SEQ ID NO: 1694, or an amino acid sequence at least 60% identical thereto, and wherein the VL comprises SEQ ID NO: 1399 or 1903, or an amino acid sequence at least 60% identical thereto.

12. The recombinant antibody of claim 1, wherein CDRH1 is SEQ ID NO: 13102, CDRH2 is SEQ ID NO: 13108, CDRH3 is SEQ ID NO: 1817, CDRL1 is SEQ ID NO: 13120, CDRL2 is SEQ ID NO: 13126, and CDRL3 is SEQ ID NO: 13 or 1883.

13. The recombinant antibody of claim 12, wherein the VH comprises SEQ ID NO: 1895, or an amino acid sequence at least 60% identical thereto, and wherein the VL comprises SEQ ID NO: 1899, or an amino acid sequence at least 60% identical thereto.

14. The recombinant antibody of claim 1, wherein CDRH1 is SEQ ID NO: 13103, CDRH2 is SEQ ID NO: 13109, CDRH3 is SEQ ID NO: 1818, CDRL1 is SEQ ID NO: 13121, CDRL2 is SEQ ID NO: 13127, and CDRL3 is SEQ ID NO: 25 or 1884.

15. The recombinant antibody of claim 14, wherein the VH comprises SEQ ID NO: 1896, or an amino acid sequence at least 60% identical thereto, and wherein the VL comprises SEQ ID NO: 1900, or an amino acid sequence at least 60% identical thereto.

16. The recombinant antibody of claim 1, wherein CDRH1 is SEQ ID NO: 13104, CDRH2 is SEQ ID NO: 13110, CDRH3 is SEQ ID NO: 1819, CDRL1 is SEQ ID NO: 13122, CDRL2 is SEQ ID NO: 13128, and CDRL3 is SEQ ID NO: 39 or 1885.

17. The recombinant antibody of claim 16, wherein the VH comprises SEQ ID NO: 1897, or an amino acid sequence at least 60% identical thereto, and wherein the VL comprises SEQ ID NO: 1901, or an amino acid sequence at least 60% identical thereto.

18. The recombinant antibody of claim 1, wherein CDRH1 is SEQ ID NO: 13105, CDRH2 is SEQ ID NO: 13111, CDRH3 is SEQ ID NO: 1820, CDRL1 is SEQ ID NO: 13123, CDRL2 is SEQ ID NO: 13129, and CDRL3 is SEQ ID NO: 49 or 1886.

19. The recombinant antibody of claim 18, wherein the VH comprises SEQ ID NO: 1898, or an amino acid sequence at least 60% identical thereto, and wherein the VL comprises SEQ ID NO: 1902, or an amino acid sequence at least 60% identical thereto.

* * * * *